United States Patent 10,766,935 (PLANT TRAITS CONFERRED BY ISOLATED POLYNUCLEOTIDES AND POLYPEPTIDES) - sequence listing, part 11

SEQ ID NO: 25668 - protein, 217 aa, Cocos nucifera
MAGYRAEDDYDYLFKVVLIGDSGVGKSNLLSRFTRNEFNLESKSTIGVEFATRSLNVDGKVIKAQIWDTAGQERYRAITSAYYRGAVGALLVYDVTRHATFENAERWLRELRDHTDPNIVVMLVGNKSDLRHLVAVSTEDGKAFAERESLYFMETSALEATNVENAFAEVLTQIYRIVSKKAVEAGDDSASAVPSKGEKINVKDDVSALKRVGCCSS

SEQ ID NO: 25669 - protein, 217 aa, Zea mays
  Sequence also found in Organisms: Sorghum bicolor, Saccharum officinarum
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFENVERWLKELRDHTDPNIVVMLVGNKSDLRHLVAVQTDEGKAFAERESLYFMETSALESTNVENAFAEVLTQIYRIVSKRAVEAGEDAASGPGKGEKINIKDDVSAVKKGGCCSS

SEQ ID NO: 25670 - protein, 215 aa, Panicum virgatum
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFENVERWLKELRDHTDPNIVVMLVGNKSDLRHLVAVQTDEGKAFAERESLYFMETSALESTNVENAFAEVLTQIYRIVSKRAVEAGEDAASGPGKGEKINIKDDVSAVKKGGCC

SEQ ID NO: 25671 - protein, 218 aa, Coffea canephora
MAGYRAEDDYDYLFKVVLIGDSGVGKSNLLSRFTRNEFSLESKSTIGVEFATRSLNVDNKVIKAQIWDTAGQERYRAITSAYYRGAVGALLVYDVTRHSTFENVERWLRELRDHTDPNIVVMLVGNKSDLRHLVAVSTEDGKSFAERESLYFMETSALEATNVDSAFAEVLTQIYHIVSKKAMEAGENGANGTVPSKGEKIDVGKDVSAMKKGGCCST

SEQ ID NO: 25672 - protein, 217 aa, Cocos nucifera
MAGYRAEDDYDYLFKVVLIGDSGVGKSNLLSRFTRNEFSLESKSTIGVEFATRSLNVDAKVIKAQIWDTAGQERYRAITSAYYRGAVGALLVYDVTRHSTFENAERWLRELRDHTDPNIVVMLVGNKSDLRHLVAVSTEDGKAFAERESLYFMETSALEATNVENAFAEVLTQIYRIVSRKAVEAADDSASPVPSKGEKINVKDDVSALKRVGCCSS

SEQ ID NO: 25673 - protein, 217 aa, Oryza sativa
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFENVERWLKELRDHTDPNIVVMLVGNKSDLRHLVAVQTDEGKAFAERESLYFMETSALESTNVENAFAEVLTQIYRIVSKRSVEAGDDAGSGPGKGEKINIKDDVSAVKKGGCCSG

SEQ ID NO: 25674 - protein, 217 aa, Phalaenopsis aphrodite
MAAYRAEDDYDYLFKVVLIGDSGVGKSNLLSRFTRNEFSLESKSTIGVEFATRSVNVDGKVIKAQIWDTAGQERYRAITSAYYRGAVGALLVYDVTRHATFENAERWLRELRDHTDPNIIVMLVGNKSDLRHLVAVSTEDSKAFAEKESLYFMETSALEATNVENAFAEVLTQIYRIVSKKIIDSGDDGTSSVPGKGEKINVKDDVSALKKAGCCSS

SEQ ID NO: 25675 - protein, 216 aa, Cleome gynandra
MAGYRADDDYDYLFKVVLIGDSGVGKSNLLSRFTRNEFSLESKSTIGVEFATRSLTVDGKVIKAQIWDTAGQERYRAITSAYYRGAVGALLVYDVTRHSTFENVERWLRELRDHTDPNIVVMLVGNKSDLRHLVAVQTDDSKSFAEKESLYFMETSALESTNVENAFAEVLTQIYHIVSKKAMEANDEAANVPSKGEKIDVSKDVSAVKKGGCCSN

SEQ ID NO: 25676 - protein, 217 aa, Glycine max
  Sequence also found in Organisms: Cajanus cajan
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDANIVVMLVGNKSDLRHLVAVSTEDGKSYAEKESLYFMETSALEATNVENAFAEVLTQIYRIVSKKAVEGAENGTASVPAKGEKIDLKNDVSALKRVGCCSS

SEQ ID NO: 25677 - protein, 217 aa, Medicago truncatula
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDSNIVVMLVGNKADLRHLVAVSTEDGKSYAEKESLYFMETSALEATNVENAFAEVLTQIYRIVSKKAVEGAENGNASVPAKGEKIDLKNDVSALKRVGCCSS

SEQ ID NO: 25678 - protein, 217 aa, Glycine max
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDANIVVMLVGNKSDLRHLVAVSTEDGKSYAEKESLYFMETSALEATNVENAFAEVLTQIYHIVSKKAVEVAENGTTSVPAKGEKIDLKNDVSALKRVGCCSS

SEQ ID NO: 25679 - protein, 214 aa, Arabidopsis thaliana
MAGYRADDDYDYLFKVVLIGDSGVGKSNLLSRFTRNEFSLESKSTIGVEFATRSLNVNEKVIKAQIWDTAGQERYRAITSAYYRGAVGALLVYDVTRHSTFENVERWLRELRDHTDPNIVVMLVGNKSDLRHLVAVQTEDAKSFAENESLYFMETSALESTNVENAFSEVLTQIYHVVSKKAMEAGEDSGNVPSKGEKIDVDVSAVKKTGCCSN

SEQ ID NO: 25680 - protein, 216 aa, Secale cereale
  Sequence also found in Organisms: Triticum aestivum
MSKLQSDALREAITNIINDCREKNRKFVETIELQIGLKNYDPQKDKRFSGSVKLPHIPRPKMRVCMLGDAQHVEEAGKMGLDCMDVESLKKMNKNKKLVKKLAKKYHAFLASEAIIKQIPRLLGPGLNKAGKFPTLVSHQESLESKVNETKATVKFQLKKVLCMGVAVGHLGMEEKQIFQNVQMSVNFLVSLLKKNWQNVRCLYLKSTMGKVYRLF

SEQ ID NO: 25681 - protein, 216 aa, Leymus cinereus x Leymus triticoides
MSKLQSESLREAITNITNDCREKNRKFVETIELQIGLKNYDPQKDKRFSGSVKLPHIPRPKMRVCMLGDAQHVEEAGKMGLDCMDVESLKKMNKNKKLVKKLAKKYHAFLASEAIIKQIPRLLGPGLNKAGKFPTLVSHQESLESKVNETKATVKFQLKKVLCMGVAVGHLGMEEKQIFQNVQMSVNFLVSLLKKNWQNVRCLYLKSTMGKVYRLF

SEQ ID NO: 25682 - protein, 215 aa, Secale cereale
SKLQSEALREAITNIINDCREKNRKFVETIELQIGLKNYDPQKDKRFSGSVKLPHIPRPKMRVCMLGDAQHVEEAGKMGLDCMDVESLKKMNKNKKLVKKLAKKYHAFLASEAIIKQIPRLLGPGLNKAGKFPTLVSHQESLESKVNETKATVKFQLKKVLCMGVAVGHLGMEEKQIFQNVQMSVNFLVSLLKKNWQNVRCLYLKSTMGKVYRLF

SEQ ID NO: 25683 - protein, 216 aa, Avena sativa
MSKLQSDSLREAITGITSDCREKNRKFSETIELQIGLKNYDPQKDKRFSGSVKLPHIPRPKMRVCMLGDAQHVEEAGKMNLDYMDVESLKKMNKNKKLVKKLAKKYHAFLASEAIIKQIPRLLGPGLNKAGKFPTLVSHQESLEAKVNETKATVKFQLKKVLCMGVAVGHMGMDEKQIFQNVQMSVNFLVSLLKKNWQNVRCLYLKSTMGKPHRLF

SEQ ID NO: 25684 - protein, 216 aa, Pennisetum glaucum
MSKLQSDVLREAIASITNDAREKQRKFVETIELQIGLKNYDPQKDKRFSGSVKLPHIPRPKMKVCMLGDAQHVEEAGRMGLDSMDVEALKKMNKNKKLVKKLAKKYHAFLASEAIIKQIPRLLGPGLNKAGKFPTLVSHQESLESKVNETKATVKFQLKKVLCMGVAVGNCGMDEKQIFQNVQMSVNFLVSLLKKNWQNVRCLYLKSTMGKVYRLF

SEQ ID NO: 25685 - protein, 216 aa, Brachypodium distachyon
MSKLQSEALREAITSITTNSRDKQRKFIETIELQIGLKNYDPQKDKRFSGSVKLPHIPRPKMRVCMLGDAQHVEEAGKLGLDCMDVESLKKMNKNKKLVKKLAKKYHAFLASEAIIKQIPRLLGPGLNKAGKFPTLVSHQESLESKVNETKATVKFQLKKVLCMGVAVGHCGMDEKQIFQNVQMSVNFLVSLLKKNWQNVRCLYLKSTMGKMHRLF

SEQ ID NO: 25686 - protein, 216 aa, Setaria italica
MSKLQSDALREAIASVTNDSREKQRKFVETIELQIGLKNYDPQKDKRFSGSVKLPHIPRPKMKVCMLGDAQHVEEAGRIGLDSMDVEALKKMNKNKKLVKKLAKKYHAFLASEAIIKQIPRLLGPGLNKAGKFPTLVSHQESLESKVNETKATVKFQLKKVLCMGVAVGNCGMDEKQIFQNVQMSVNFLVSLLKKNWQNVRCLYLKSTMGKVYRLF

SEQ ID NO: 25687 - protein, 216 aa, Sorghum bicolor
  Sequence also found in Organisms: Saccharum officinarum
MSKLQSDALREAIASITNDSREKQRKFVETIELQIGLKNYDPQKDKRFSGSVKLPHIPRPKMKVCMLGDAQHVEEAERIGLDSMDVEALKKMNKNKKLVKKLAKKYHAFLASEAIIKQIPRLLGPGLNKAGKFPTLVTHQESLESKVNETKATVKFQLKKVLCMGVAVGNCGMEEKQIFQNVQMSVNFLVSLLKKNWQNVRCLYLKSTMGKVYRVF

SEQ ID NO: 25688 - protein, 216 aa, Cenchrus ciliaris
MSKLQSDALRDAIASITNDSREKPRKFVETIELQIGLKNYDPQKDKRFSGSVKLPHIPRPKMKVCMLGDAQHVEEAARIGLDSMDVEALKKMNKNKKLVKKLAKKYHAFLASEAIIKQIPRLLGPGLNKAGKFPTLVSHQESLESKVNETKATVKFQLKKVLCMGVAVGNCGMDEKQIFQNVQMSVNFLVSLLKKNWQNVRCLYLKSTMGKVYRLF

SEQ ID NO: 25689 - protein, 216 aa, Oryza sativa
MSKLQSDALREAISQIANDSREKQRKFVETIELQIGLKNYDPQKDKRFSGSVKLPHIPRPKLKVCMLGDAQHVEEAEKMGLDYMDVEALKKMNKNKKLVKKLAKKYHAFLASEAIIKQIPRLLGPGLNKAGKFPTLVTHQESLESKVNETKATVKFQLKKVLCMGVAVGNCAMEEKQIFQNVQMSVNFLVSLLKKNWQNVRCLYLKSTMGKVYRVF

SEQ ID NO: 25690 - protein, 216 aa, Oryza sativa
MSKLQSDALREAISQITSESREKQRKFVETIELQIGLKNYDPQKDKRFSGSVKLPHIPRPKMKVCMLGDAQHVEEAEKMGLDYMDVEALKKMNKNKKLVKKLAKKYHAFLASEAIIKQIPRLLGPGLNKAGKFPTLVTHQESLESKVNETKATVKFQLKKVLCMGVAVGNCAMEEKQIFQNVQMSVNFLVSLLKKNWQNVRCLYLKSTMGKVIRVF

SEQ ID NO: 25691 - protein, 216 aa, Zea mays
MSKLQSDSLRDAIASITNDSREKQRKFVETIELQIGLKNYDPQKDKRFSGSVKLPHIPRPKMKVCMLGDAQHVEEAERMGIDNMDVEALKKMNKNKKLVKKLAKKYHAFLASEAIIKQIPRLLGPGLNKAGKFPTLVTHQESLESKVNETKATVKFQLKKVLCMGVAVGNCGMDEKQIFQNVQMSVNFLVSLLKKNWQNVRCLYLKSTMGKVYRLF

SEQ ID NO: 25692 - protein, 216 aa, Distylium racemosum
MSKLQSDVLREAITQVMADSKEKNRKFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVSHQESLEAKVNETKATVKFQLKKVLCMGVAVGNCGMEEKQVFQNVQMSVNFLVSLLKKNWQNVRCLYLKSTMGKPSRIF

SEQ ID NO: 25693 - protein, 216 aa, Pinus pinaster
MSKLQSDALREAISQIMGDTKEKQRKFTETIELQIGLKNYDPQKDKRFSGSVKLPHIPRPKMKVCMLGDAQHVEEAEKLGLDYMDVEGLKKMNKNKKLVKKLAKKYHAFLASEAIIKQIPRLLGPGLNKAGKFPTLVSHQESLEGKVNETKATVKFQLKKVLCMGVAVGNCGMEEKQIFQNVQLSVNFLVSLLKKNWQNVRCLYLKSTMGKPNRVF

SEQ ID NO: 25694 - protein, 216 aa, Arachis hypogaea
MSKLQSDALREAITGIVADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQLSVNFLVSLLKKNWQNVRCLYLKSTMGKSYRVF

SEQ ID NO: 25695 - protein, 216 aa, Pseudotsuga menziesii
MSKLQSDALREAISQVMADSKEKQRKFTETIELQIGLKNYDPQKDKRFSGSVKLPHIPRPKMKVCMLGDAQHVEEAEKLGLDYMDVEGLKKMNKNKKLVKKLAKKYHAFLASEAIIKQIPRLLGPGLNKAGKFPTLVSHQESLEGKVNETKATVKFQLKKVLCMGVAVGNCGMEEKQIFQNVQLSVNFLVSLLKKNWQNVRCLYLKSTMGKPNRIF

SEQ ID NO: 25696 - protein, 216 aa, Cyamopsis tetragonoloba
MSKLQSDALREAISGIMTDSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQMSVNFLVSLLKKNWQNVRCLYLKSTMGKSYRVF

SEQ ID NO: 25697 - protein, 216 aa, Glycyrrhiza uralensis
MSKLQSDALREAISGIMADSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQMSVNFLVSLLKKNWQNVRCLYLKSTMGKSYRVF

SEQ ID NO: 25698 - protein, 216 aa, Vigna unguiculata
MSKLQSDALREAITGIMGDSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQLSVNFLVSLLKKNWQNVRCLYLKSTMGKSYRVF

SEQ ID NO: 25699 - protein, 216 aa, Podocarpus macrophillus
MSKLQSDVLRESITQIMNDSKEKKRKFSETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVSHQESLEAKVNETKATVKFQLKKVLCMGVAVGNCGMEEKQVFQNVQMSVNFLVSLLKKNWQNVRCLYLKTTMGKPTRVF

SEQ ID NO: 25700 - protein, 216 aa, Cleome spinosa
MSKLQSDALREAISIIKGKCEEKKRNFVETIELQIGLKNYDPQKDKRFSGSVKLPHIPRPKMKVCMLGDAQHVEEAEKMGLDYMDVEALKKLNKNKKLVKKLAKKYHAFLASESVIKQIPRLLGPGLNKAGKFPTLVSHQESLESKVNETKATVKFQLKKVLCMGVAVGNLAMEEKQIFQNVQMSVNFLVSLLKKNWQNVRCLYLKSTMGPPQRIF

SEQ ID NO: 25701 - protein, 216 aa, Sarracenia psittacina
MSKLQSDALREAITQIANDAKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVSHQESLESKVNETKATVKFQLKKVLCMGVAVGNCSMEEKQIFQNVQMSVNFLVSLLKKNWQNVRCLYLKSTMGKPVRIF

SEQ ID NO: 25702 - protein, 216 aa, Fagopyrum esculentum
MSKLQSEALREAISGIVNDTKEKARKFTETIELQIGLKNYDPQKDKRFSGSVKLPHIPRPKMKVCMLGDAQHVEESEKMGLDYMDVEALKKLNKNKKLVKKLAKKYHAFLASESVIKQIPRLLGPGLNKAGKFPTLVSHQESLESKVNEIKATVKFQLKKVLCMGVAVGNCGMEEKQIFQNVQMSVNFLVSLLKKNWQNVRCLYLKSTMGKPYRIF

SEQ ID NO: 25703 - protein, 216 aa, Fagopyrum esculentum
MSKLQSEALREAISGITNDSKEKARKFTETIELQIGLKNYDPQKDKRFSGSVKLPHIPRPKMKVCMLGDAQHVEESEKMGLDYMDVEALKKLNKNKKLVKKLAKKYHAFLASESVIKQIPRLLGPGLNKAGKFPTLVSHQESLESKVNEIKATVKFQLKKVLCMGVAVGNCGMEEKQIFQNVQMSINFLVSLLKKNWQNVRCLYLKSTMGKPYRIF

SEQ ID NO: 25704 - protein, 216 aa, Glycine max
MSKLQSDALREAISGIMTDSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQLSVNFLVSLLKKNWQNVRCLYLKSTMGKSYRVF

SEQ ID NO: 25705 - protein, 216 aa, Elaeis guineensis
MSKLQSDVLREAISQIANDAREKKRNFIETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVTHQESLEAKVNETKAMVKFQLKKVLCMGVAVGNCAMEEKQIFQNVQLSVNFLVSLLKKNWQNVRCLYLKSTMGKPYRVF

SEQ ID NO: 25706 - protein, 216 aa, Glycine max
MSKLQSDALREAISGIMADSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQLSVNFLVSLLKKNWQNVRCLYLKSTMGKSYRVF

SEQ ID NO: 25707 - protein, 216 aa, Panax ginseng
MSKLQSDALREAITQISNEAKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNLSMEEKQIFQNVQMSVNFLVSLLKKNWQNVRCLYLKSTMGKTVRIF

SEQ ID NO: 25708 - protein, 216 aa, Nuphar advena
MSKLQSDALREAITQVVGEARDKKRKFTETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVSHQESLESKVNETKAMVKFQLKKVLCMGVAVGNCGMEEKQIFQNVQLSVNFLVSLLKKNWQNVRCLYLKSTMGRAIRVF

SEQ ID NO: 25709 - protein, 216 aa, Antirrhinum majus
MSKLQSEALREAITVITADAKEKKRNFTETVELQIGLKNYDPQKDKRFSGSVKLPHIPRPKMKICMLGDAQHVEEAAKIGLESMDVEALKKLNKNKKLVKKLAKKYHAFLASEAVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMGKPQRIF

SEQ ID NO: 25710 - protein, 216 aa, Mimulus guttatus
MSKLQSDAVREAITQIAADCKEKNRKFTETIELQIGLKNYDPQKDKRFSGSVKLPHIPRPKMKICMLGDAQHVEEATKIGLESMDVEALKKLNKNKKLVKKLAKKYHAFLASEAVIKQIPRLLGPGLNKAGKFPTLVSHQESLEAKVNETKATVKFQLKKVLCMGVAVGNLSMEEKQIFQNVQMSVNFLVSLLKKNWQNVRCLYLKSTMGRPQRVF

SEQ ID NO: 25711 - protein, 216 aa, Cleome spinosa
MSKLQSEALREAISTIKAKCEEKKRNFVETIELQIGLKNYDPQKDKRFSGSVKLPHIPRPKMKICMLGDAQHVEEAEKMGLDYMDVEALKKLNKNKKLVKKLAKKYHAFLASESVIKQIPRLLGPGLNKAGKFPTLVSHQESLESKVNETKATVKFQLKKVLCMGVAVGNLSMEEKQIFQNVQMSVNFLVSLLKKNWQNVRCLYLKSTMGPVQRIF

SEQ ID NO: 25712 - protein, 216 aa, Solanum melongena
MSKLQSDALREAISVIKNDANEKKRKFTETIELQIGLKNYDPQKDKRFSGSVKLPHIPRPKMKICMLGDAQHVEEAEKIGLEYMDVESLKKLNKNKKLVKKLAKKYHAFLASEAVIKQIPRLLGPGLNKAGKFPTLVSHQESLESKVNETKATIKFQLKKVLCMGVAVGNMDMEEKQIFQNVQMSVNFLVSLLKKNWQNVRCLYLKSTMGKTQRIF

SEQ ID NO: 25713 - protein, 216 aa, Nicotiana tabacum
MSKLQSDALREAISVIKNDCAEKKRKFTETIELQIGLKNYDPQKDKRFSGSVKLPHIPRPKMKICMLGDAQHVEEAEKIGLEYMDVESLKKLNKNKKLVKKLAKKYHAFLASESVIKQIPRLLGPGLNKAGKFPSLVSHQESLESKVNETKATIKFQLKKVLCMGVAVGNLDMEEKQIFQNVQMSVNFLVSLLKKNWQNVRCLYLKSTMGKPQRVF

SEQ ID NO: 25714 - protein, 216 aa, Nicotiana tabacum
MSKLQSDALREAISVIKNDCNEKKRKFTETIELQIGLKNYDPQKDKRFSGSVKLPHIPRPKMKICMLGDAQHVEEAEKIGLEYMDVESLKKLNKNKKLVKKLAKKYHAFLASESVIKQIPRLLGPGLNKAGKFPSLVSHQESLESKVNETKATIKFQLKKVLCMGVAVGNLDMEEKQIFQNVQMSVNFLVSLLKKNWQNVRCLYLKSTMGKTQRVF

SEQ ID NO: 25715 - protein, 216 aa, Tabernaemontana elegans
MSKLQSDALREAISQIKNDAAEKKRKFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNCDMEEKQIFQNVQMSVNFLVSLLKKNWQNVRCLYLKSTMGKPQRIF

SEQ ID NO: 25716 - protein, 216 aa, Cedrus atlantica
MSKLQSDALREAISQVMADSKEKQRKFTETIELQIGLKNYDPQKDKRFSGSVKLPHIPRPKMKVCMLGDAQHVEEAEKLGLDYMDVEGLKKMNKNKKLVKKLAKKYHAFLASEAIIKQIPRLLGPGLNKAGKFPTLVSHQESLEGKINETKATVKFQLKKVLCMGVAVGNCGMEEKQIFQNVQLSVNFLVSLLKKNWQNVRCLYLKSTMGKTNRIF

SEQ ID NO: 25717 - protein, 216 aa, Sorghum bicolor
MSKLQSEVLKDAISQIVGDAKEKNRKFTETVELQIGLKNYDPQKDKRFSGSVKLPHIPRPKMKVCMLGDAQHVEEAEKMGLDYMDVESLKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYVKSTMGKPYRVF

SEQ ID NO: 25718 - protein, 216 aa, Musa acuminata
MSKLQSDVLREAISQVVGDSREKKRKFTETVELQIGLKNYDPQKDKRFSGSVKLPHIPRPKMKVCMLGDAQHVEEAEKIGLDYMDVESLKKMNKNKKLVKKLAKKYHAFLASEAIIKQIPRLLGPGLNKAGKFPTLVTHQESLEAKVNETKAMVKFQLKKVLCMGVAVGNCAMEEKQIFQNVQLSVNFLVSLLKKNWQNVRCLYLKSTMGKPYRVF

SEQ ID NO: 25719 - protein, 216 aa, Olea europaea
MSKLQSEALREAISVIVTDSKEKNRNFTETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLESKVNETKATVKFQLKKVLCMGVAVGNLGMEEKQVFQNVQMSVNFLVSLLKKNWQNVRCLYLKSTMGKPQRIF

SEQ ID NO: 25720 - protein, 216 aa, Ananas comosus
MSKLQSDALKEAISQVVGDSREKKRKFTETVELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVTHQESLEAKVNETKATVKFQLKKVLCMGVAVGNCGMEEKQIQQNVQLSVNFLVSLLKKNWQNVRCLYLKSTMGKPYRVF

SEQ ID NO: 25721 - protein, 216 aa, Musa acuminata
MSKLQSDVLREAISQVAGDSREKKRKFTETVELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVTHQESLESKVNETKAMVKFQLKKVLCMGVAVGNCAMEEKQIFQNVQLSVNFLVSLLKKNWQNVRCLYLKSTMGKPYRVF

SEQ ID NO: 25722 - protein, 216 aa, Persea americana
MSKLQSDVLREAISIVVADAREKKRNFTETIELQIGLKNYDPQKDKRFSGSVKLPHIPRPKMKVCMLGDAQHVEEAEKMGLEYMDVEGLKKMNKNKKLVKKLAKKYHAFLASEAIIKQIPRLLGPGLNKAGKFPTLVSHQESLESKVNETKAMVKFQLKKVLCMGVAVGNCGMEEKQIFQNVQLSVNFLVSLLKKNWQNVRCLYLKSSMGKPNRIF

SEQ ID NO: 25723 - protein, 216 aa, Picea glauca
MSKLQSDVLREAISQVMADSKEKQRKFTETIELQIGLKNYDPQKDKRFSGSVKLPHIPRPKMKVCMLGDAQHVEEAEKLGLDYMDVEGLKKMNKNKKLVKKLAKKYHAFLASEAIIKQIPRLLGPGLNKAGKFPTLVSHQESLEGKVNETKATVKFQLKKVLCMGVAVGNCGMEEKQIFQNVQLSVNFLVSLLKKNWQNVRCLYLKTTMGKPNRIF

SEQ ID NO: 25724 - protein, 216 aa, Zamia vazquezii
MSKLQSDVLREAITQVVTDSKEKKRKFSETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVSHQESLEAKVNETKAMVKFQLKKVLCMGVAVGNCGMEEKQVFQNVQLSVNFLVSLLKKNWQNVRCLYLKSTMGKPNRIF

SEQ ID NO: 25725 - protein, 216 aa, Cryptomeria japonica
MSKLQSDVLREAITGLVGESKEKNRKFVETIELQIGLKNYDPQKDKRFSGSVKLPHIPRPKMKLCMLGDAQHVEEAEKIGLDYMDVEGLKKMNKNKKLVKKLAKKYHAFLASEAIIKQIPRLLGPGLNKAGKFPTLVSHQESLEGKVNETKATIKFQLKKVLCMGVAVGNCGMDEKQIFQNVQLSVNFLVSLLKKNWQNVRCLYLKSTMGKPSRVF

SEQ ID NO: 25726 - protein, 216 aa, Nicotiana tabacum
MSKLQSEALREAISVIKNDCNEKKRKFTETIELQIGLKNYDPQKDKRFSGSVKLPHIPRPKMKICMLGDAQHVEEAEKIGLEYMDVESLKKLNKNKKLVKKLAKKYHAFLASESVIKQIPRLLGPGLNKAGKFPSLVSHQESLESKVNETKATIKFQLKKVLCMGVAVGNLDMEEKQIFQNVQMSVNFLVSLLKKNWQNVRCLYLKSTMGKTQRVF

SEQ ID NO: 25727 - protein, 216 aa, Phaseolus vulgaris
  Sequence also found in Organisms: Vigna unguiculata
MSKLQSDALREAITGIMADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQETLESKVNESKAMVKFQLKKVLCMGVAVGNVSMEEKQIFQNVQLSVNFLVSLLKKNWQNVRCLYLKSTMGKSYRVF

SEQ ID NO: 25728 - protein, 216 aa, Cleome gynandra
MSKLQSEALREAISTIKGKCEEKKRNFVETIELQIGLKNYDPQKDKRFSGSVKLPHIPRPKMKICMLGDAQHVEEAEKMGLDYMDVEALKKLNKNKKLVKKLAKKYHAFLASESVIKQIPRLLGPGLNKAGKFPTLVSHQESLESKVNETKATVKFQLKKVLCMGVAVGNIGMEEKQIFQNVQMSVNFLVSLLKKNWQNVRCLYLKSTMGPPQRIF

SEQ ID NO: 25729 - protein, 216 aa, Nicotiana tabacum
MSKLQSDALREAISVIKNDCAEKKRKFTETIELQIGLKNYDPQKDKRFSGSVKLPHIPRPKMKICMLGDAQHVEEAEKIGLEYMDVESLKKLNKNKKLVKKLAKKYHAFLASESVIKQIPRLLGPGLNKAGKFPSLVSHQESLESKVNETKATIKFQLKKVLCMGVAVGNLDMEEKQIFQNVQMSVNFLVSLLKKNWQNVRCLYLKGTMGKPQRVF

SEQ ID NO: 25730 - protein, 216 aa, Solanum lycopersicum
  Sequence also found in Organisms: Solanum tuberosum, Solanum phureja
MSKLQSDALREAITVIKNDSSEKKRKFTETIELQIGLKNYDPQKDKRFSGSVKLPHIPRPKMKICMLGDAQHVGEAEKIGLEYMDVEGLKKLNKNKKLVKKLAKKYHAFLASEAVIKQIPRLLGPGLNKAGKFPTLVSHQESLESKVNETKATIKFQLKKVLCMGVAVGNMDMEEKQIFQNVQMSVNFLVSLLKKNWQNVRCLYLKSTMGKTQRIF

SEQ ID NO: 25731 - protein, 216 aa, Amorphophallus konjac
MSKLQSDVLREAIGQLVTDSKEKKRKFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKAMVKFQLKKVLCMGVAVGNCGMEEKQIFQNVQLSVNFLVSLLKKNWQNVRCLYLKSTMGKPVRVF

SEQ ID NO: 25732 - protein, 216 aa, Chelidonium majus
MSKLQSDVLREAITQIVNDAKEKKRNFTETIELQIGLKNYDPQKDKRFSGSVKLPHIPRPKMKVCMLGDAQHVEEAEKIGLSYMDVEGLKKLNKNKKLVKKLAKKYHAFLASEAVIKQIPRLLGPGLNKAGKFPTLVTHQESLESKVNETKAMVKFQLKKVLCMGVAVGNLGMEEKQIFQNVQLSVNFLVSLLKKNWQNVRCLYLKSTMGKPNRVF

SEQ ID NO: 25733 - protein, 216 aa, Sarracenia psittacina
MSKLQSEALREAISQISNDAKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVSHQESLESKVNETKATVKFQLKKVLCMGVAVGNCSMEEKQIFQNVQMSVNFLVSLLKKNWQNVRCLYLKSTMGKPVRIF

SEQ ID NO: 25734 - protein, 216 aa, Eschscholzia californica
MSKLQSDVLREAITQIVGDAKEKKRNFTETIELQIGLKNYDPQKDKRFSGSVKLPHIPRPKMKVCMLGDAQHVEEAEKIGLAYMDVESLKKLNKNKKLVKKLAKKYHAFLASEAVIKQIPRLLGPGLNKAGKFPTLVSHQESLEAKVNETKAMVKFQLKKVLCMGVAVGNLGMEEKQIFQNVQLSVNFLVSLLKKNWQNVRCLYLKSTMGKTNRIF

SEQ ID NO: 25735 - protein, 216 aa, Primula obconica
MSKLQSDVLREAITQIHKDSTEKSRKFTETIELQIGLKNYDPQKDKRFSGSVKLPHIPRPKMKVCMLGDAHHINEAEKIGLEYMDVESLKKLNKNKKLVKKLAKKYHAFLASEAVIKQIPRLLGPGLNKAGKFPTLVSQQESLESKVNETKATVKFQLKKVLCMGVAVGNLGMEEKQIFQNVQMSVNFLVSLLKKNWQNVRCLYLKSTMGKPVRVF

SEQ ID NO: 25736 - protein, 216 aa, Fraxinus spp
MSKLQSEALREAISVITTDVKEKNRNFVETIELQIGLKNYDPQKDKRFSGSVKLPHIPRPKMKICMLGDAQHVEEAEKIGMESMDVEALKKLNKNKKLVKKLAKRYHAFLASEAVIKQIPRLLGPGLNKAGKFPTLVSHQESLESKVNETKATVKFQLKKVLCMGVAVGNCGMEEKQIFQNVQMSVNFLVSLLKKNWQNVRCLYLKSTMGKPQRIF

SEQ ID NO: 25737 - protein, 216 aa, Cicer arietinum
MSKLQSDALREAISGITADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPALVSHQESLESKVNETKAMVKFQLKKVLCMGVAVGNVSMDEKQIFQNVQLSVNFLVSLLKKNWQNVRCLYLKSSMGKSYRVF

SEQ ID NO: 25738 - protein, 216 aa, Cicer arietinum
MSKLQSDALREAISGITADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPALVSHQESLESKVNETKAMVKFQLKKVLCMGVAVGNISMDEKQIFQNVQLSVNFLVSLLKKNWQNVRCLYLKSSMGKSYRVF

SEQ ID NO: 25739 - protein, 216 aa, Glycine max
  Sequence also found in Organisms: Cajanus cajan
MSKLQSDALREAISGIMADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQETLESKVNESKAMVKFQLKKVLCMGVAVGNVSMEEKQIFQNVQLSVNFLVSLLKKNWQNVRCLYLKSTMGKSYRVF

SEQ ID NO: 25740 - protein, 216 aa, Setaria italica
MSKLQSEVLKEAISQIVGDSKEKNRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRVF

SEQ ID NO: 25741 - protein, 216 aa, Panicum virgatum
MSKLQSEALKDAISQIVGDAKEKNRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRVF

SEQ ID NO: 25742 - protein, 216 aa, Eutrema parvulum
MSKLQSEAVREAITVIRAKSDEKKRNFVETLELQIGLKNYDPQKDKRFSGSVKLPHIPRPKMKICMLGDAQHVEEADKMGLDYMDVESLKKLNKNKKLVKKLAKKYHAFLASESVIKQIPRLLGPGLNKAGKFPTLVSHQESLESKVNETKATVKFQLKKVLCMGVAVGNLSMEEKQIFQNVQMSVNFLVSLLKKNWQNVRCLYLKSTMGPPQRIF

SEQ ID NO: 25743 - protein, 216 aa, Oryza sativa
MSKLQTEALKEAISQVVADCKEKNRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRVF

SEQ ID NO: 25744 - protein, 216 aa, Saccharum officinarum
MSKLQSEVLKDAISQIVGDAKEKNRKFTETVELQIGLKNYDPQKDKRFSGSVKLPHIPRPKMKVCMLGDAQHVEEAEKMGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYVKSTMGKPYRVF

SEQ ID NO: 25745 - protein, 216 aa, Actinidia deliciosa
MSKLQSEALREAISQIANDAKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNCSMEEKQIFQNVQMSVNFLVSLLKKNWQNVRCLYLKSTMGKPVRVF

SEQ ID NO: 25746 - protein, 216 aa, Cycas rumphii
MSKLQGDVLREAIAQVMADSKEKKRKFSETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVSHQESLEAKVNETKAMVKFQLKKVLCMGVAVGNCGMEEKQIFQNVQLSVNFLVSLLKKNWQNVRCLYLKSTMGKPNRIF

SEQ ID NO: 25747 - protein, 216 aa, Petunia hybrida
MSKLQSDALREAISVIKNDSNEKKRKFTETVELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNETKATIKFQLKKVLCMGVAVGNLDMEEKQIFQNVQMSVNFLVSLLKKNWQNVRCLYLKSTMGKTQRIF

SEQ ID NO: 25748 - protein, 216 aa, Phaseolus vulgaris
MSKLQSDALREAISGIMGDSKEKNRNFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMDEKQIFQNVQLSVNFLVSLLKKNWQNVRCLYLKSTMGKSYRVF

SEQ ID NO: 25749 - protein, 216 aa, Cucumis sativus
  Sequence also found in Organisms: Cucumis melo
MSKLQSDALREAISSIFADSGEKKRKFTETIELQIGLKNYDPQKDKRFSGSVKLPHIPRPKMKICMLGDASHVEEAEKIGLDYMDVEGLKKLNKNKKLVKKLAKKYHAFLASEAIIKQIPRLLGPGLNKAGKFPTLVTHQESLESKVNETKAMVKFQLKKVLCMGVAVGNIAMEEKQVFQNVQMSVNFLVSLLKKNWQNVRCLYLKSTMGKAYRVF

SEQ ID NO: 25750 - protein, 216 aa, Momordica charantia
MSKLQSDALREAITSIFSDSNEKKRKFTETIELQIGLKNYDPQKDKRFSGSVKLPHIPRPKMKICMLGDALHVEEAEKIGLDYMDVEGLKKLNKNKKLVKKLAKKYHAFLASEAVIKQIPRLLGPGLNKAGKFPTLVTHQESLESKVNETKAMVKFQLKKVLCMGVAVGNVSMEEKQVFQNVQMSVNFLVSLLKKNWQNVRCLYLKSTMGKSYRVF

SEQ ID NO: 25751 - protein, 216 aa, Petunia hybrida
MSKLQSDALREAISVITKDSAEKKRKFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNEIKATVKFQLKKVLCMGVAVGNMDMEEKQIFQNVQMSVNFLVSLLKKNWQNVRCLYSKSTMGKTQRIF

SEQ ID NO: 25752 - protein, 216 aa, Sequoia sempervirens
MSKLQSDVLREAITGLVGESKDKKRKFVETIELQIGLKNYDPQKDKRFSGSVKLPHIPRPKMKLCMLGDAQHVEEAEKIGLDYMDVEGLKKMNKNKKLVKKLAKKYHAFLASEAIIKQIPRLLGPGLNKAGKFPTLVSHQESLEGKVNETKATIKFQLKKVLCMGVAVGNCGMEEKQIFQNVQLSVNFLVSLLKKNWQNVRCLYLKSTMGKPSRIF

SEQ ID NO: 25753 - protein, 216 aa, Antirrhinum majus
MSKLQSEALREAISVISGDVKEKKRNFTETIELQIGLKNYDPQKDKRFSGSVKLPHIPRPKMKICMLGDAQHVEEAAKIGLESMDVEALKKLNKNKKLVKKLAKKYHAFLASEAVIKQIPRLLGPGLNKAGKFPTLVSHQESLESKVNETKATVKFQLKKVLCMGVAVGNCGMEEKQIFQNVQMSVNFLVSLLKKNWQNVRCLYLKSTMGKPQRIF

SEQ ID NO: 25754 - protein, 216 aa, Actinidia deliciosa
MSKLQSDAVREAISQIAGDSKEKKRKFVETIELQIGLKNYDPQKDKRFSGSVKLPHIPRPKMKVCMLGDAQHVEEAEKIGMDYMDVEGLKKLNKNKKLVKKLAKKYHAFLASEAVIKQIPRLLGPGLNKAGKFPTLVTHQESLESKVNETKATVKFQLKKVLCMGVAVGNCGMEDKQIFQNVQMSVNFLVSLLKKNWQNVRCLYLKSTMGRPVRIF

SEQ ID NO: 25755 - protein, 216 aa, Glycine max
MSKLQSDALREAISGIMADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQETLESKVNESKAMVKFQLKKVLCMGVAVGNVSMEEKQIFQNVQLSVNFLVSLLKKNWQNVRCLYLKSTMGKCYRVF

SEQ ID NO: 25756 - protein, 216 aa, Solanum melongena
MSKLQSEALREAISVIKNDSAEKKRKFSETIELQIGLKNYDPQKDKRFSGSVKLPHIPRPKMKICMLGDAQHVEEAEKIGLEYMDVESLKKLNKNKKLVKKLAKKYHAFLASESVIKQIPRLLGPGLNKAGKFPTLVSHQESLESKVNETKATIKFQLKKVLCMGVAVGNCDMEEKQIFQNVQMSVNFLVSLLKKNWQNVRCLYLKSTMGKTQRIF

SEQ ID NO: 25757 - protein, 216 aa, Eschscholzia californica
MSKLQSEVLREAITQITADAKEKARKFTETVELQIGLKNYDPQKDKRFSGSVKLPHIPRPKMKVCMLGDAQHVEEAEKIGLDYMDVEGLKKLNKNKKLVKKLAKKFHAFLASEAVIKQIPRLLGPGLNKAGKFPTLVSHQESLEAKVNETKAMVKFQLKKVLCMGVAVGNLGMEEKQIFQNVQLSVNFLVSLLKKNWQNVRCLYLKSTMGKPVRIF

SEQ ID NO: 25758 - protein, 216 aa, Arabidopsis thaliana
MSKLQSEAVREAITTITGKSEAKKRNFVETIELQIGLKNYDPQKDKRFSGSVKLPHIPRPKMKICMLGDAQHVEEAEKMGLENMDVESLKKLNKNKKLVKKLAKKYHAFLASESVIKQIPRLLGPGLNKAGKFPTLVSHQESLESKVNETKATVKFQLKKVLCMGVAVGNLSMEEKQIFQNVQMSVNFLVSLLKKNWQNVRCLYLKSTMGPPQRIF

SEQ ID NO: 25759 - protein, 212 aa, Elaeis guineensis
MSKLQSDVLREAISQLTNDSREKKRNFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKAMVKFQLKKVLCMGVAVGNCAMEEKQIFQNVQLSVNFLVSLLKKNWQNVRCLYLKSTMGKP

SEQ ID NO: 25760 - protein, 216 aa, Phalaenopsis aphrodite
MSKLQSDVLREAISQLVNDSREKKRNFTETIELQIGLKNYDPQKDKRFSGSVKLPHIPRPKMKVCMLGDAQHVEEAEKIGLEWMDVEGLKKMNKNKKLVKKLAKKYHAFLASEAIIKQIPRLLGPGLNKAGKFPTLVTHQETLESKVNETKAMVKFQLKKVLCMGVAVGNCAMEEKQIFQNVQLSVNFLVSLLKKNWQNVRCLYLKSTMGKPYRVF

SEQ ID NO: 25761 - protein, 216 aa, Elaeis guineensis
MSKLQSDVLREAISQIMNDTKEKKRNFTETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVTHQESLEAKVNETKAMVKFQLKKVLCMGVAVGNCAMEEKQVFQNVQLSVNFLVSLLKKNWQNVRCLYLKSTMGKPYRVF

SEQ ID NO: 25762 - protein, 216 aa, Lippia dulcis
MSKLQSDALREAISVITSDAKEKKRNFTETVELQIGLKNYDPQKDKRFSGSVKLPHIPRPKMKICMLGDAQHVEEAAKIGLESMDVEALKKLNKNKKLVKKLAKKYHAFLASEAVIKQIPRLLGPGLNKAGKFPTLVTHQESLESKVNETKATVKFQLKKVLCMGVAVGNLDMEEKQIFQNVQMSVNFLVSLLKKNWQNVRCLYLKSTMGKPQRIF

SEQ ID NO: 25763 - protein, 216 aa, Fraxinus spp
MSKLQSEALREAVSVIVTDSKEKKRNFTETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMGKPQRIF

SEQ ID NO: 25764 - protein, 216 aa, Olea europaea
MSKLQSEALREAISVIVTDSKEKKRNFTETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLESKVNETKATVKFQLKKVLCMGIAVGNLGMEEKQIFQNVQMSVNFLVSLLKKNWQNVRCLYLKSTMGKPQRIF

SEQ ID NO: 25765 - protein, 216 aa, Plantago ovata
MSKLQSEALREAITAITADAKEKNRKFTETIELQIGLKNYDPQKDKRFSGSVKLPHIPRPKMKICMLGDAQHVEEAEKIGMESMDVEALKKLNKNKKLVKKLAKKYHAFLASEAVIKQIPRLLGPGLNKAGKFPTLVSHQESLESKVNETKATVKFQLKKVLCMGVAVGNCAMEDKQIFQNVQMSVNFLVSLLKKNWQNVRCLYLKTTMGKPQRIF

SEQ ID NO: 25766 - protein, 216 aa, Cicer arietinum
MSKLQSEALREAISGITADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPALVSHQESLESKVNETKAMVKFQLKKVLCMGVAVGNISMDEKQIFQNVQLSVNFLVSLLKKNWQNVRCLYLKSSMGKSYRVF

SEQ ID NO: 25767 - protein, 216 aa, Picea glauca
MSKLQSDVLREAISQVMADSKEKQRKFTETIELQIGLKNYDPQKDKRFSGSVKLPHIPRPKMKVCMLGDAQHIEEAEKISLDYMDVEGLKKMNKNKKLVKKLAKKYHAFLASEAIIKQIPRLLGPGLNKAGKFPTLVSHQESLESKVNETKATVKFQLKKVLCMGVAVGNCGMEEKQVFQNVQLSVNFLVSLLKKNWQNVRCLYLKSTMGKPARVF

SEQ ID NO: 25768 - protein, 216 aa, Panicum virgatum
MSKLQTEALKEAISLVVSEAREKNRKFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPNRVF

SEQ ID NO: 25769 - protein, 216 aa, Hordeum vulgare
  Sequence also found in Organisms: Triticum aestivum
MSKLQSDAVKDAITQIVGEAREKKRKFTETVELQIGLKNYDPQKDKRFSGSVKLPHIPRPKMRVCMLGDAQHVDQAEKMGLDYMDVESLKKMNKNKKLVKKLAKKYHAFLASEAIIKQIPRLLGPGLNKAGKFPTLVSHQESLEAKVNETKATVKFQLKKVLCMGVAVGNLSMDEKQIQQNIQMSVNFLVSLLKKNWQNVRCLYVKSTMGKRVRVF

SEQ ID NO: 25770 - protein, 216 aa, Abies balsamea
MSKLQSDVLREGITQIMGESKDKKRKFTETIELQIGLKNYDPQKDKRFSGSVKLPHIPRPKMKVCMLGDAQHVEEAEKISLDYMDVEGLKKMNKNKKLVKKLAKKYHAFLASEAIIKQIPRLLGPGLNKAGKFPTLVSHQESLEFKVNETKATVKFQLKKVLCMGVAVGNCGMEEKQVFQNVQLSVNFLVSLLKKNWQNVRCLYLKSTMGKPARVF

SEQ ID NO: 25771 - protein, 216 aa, Theobroma cacao
MSKLQSDALREAISTIVAQSKEKNRKFTETIELQIGLKNYDPQKDKRFSGSVKLPHIPRPKMKICMLGDAQHVEEAEKIGLDYMDVEALKKLNKNKKLVKKLAKKYQAFLASEAIIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRIF

SEQ ID NO: 25772 - protein, 216 aa, Pennisetum glaucum
  Sequence also found in Organisms: Cenchrus ciliaris
MSKLQTEVLKEAISQIVVASKEKNRKFTETVELQIGLKNYDPQKDKRFSGSVKLPHIPRPKMKVCMLGDAQHVEEAEKLGLDYMDVESLKKMNKNKKLVKKLAKKYHAFLASEAIIKQIPRLLGPGLNKAGKFPTLVSHQESLEAKVNETKATVKFQLKKVLCMGVAVGNLSMEEKQIQQNIQMSVNFLVSLLKKNWQNVRCLYVKSTMGKPYRVF

SEQ ID NO: 25773 - protein, 216 aa, Capsicum annuum
MSKLQSEALREAISVIKNDANEKKRKFTETIELQIGLKNYDPQKDKRFSGSVKLPHIPRPKMKICMLGDAQHVGEAEKIGLEYMDVEGLKKLNKNKKLVKKLAKKYHAFLASEAVIKQIPRLLGPGLNKAGKFPTLVSHQESLESKVNETKATIKFQLKKVLCMGVAVGNMDMEEKQIFQNVQMSVNFLVSLLKKNWQNVRCLYLKSTMGKTQRIF

SEQ ID NO: 25774 - protein, 216 aa, Panicum virgatum
MSKLQSEVLKDAISQIVGDAKEKNRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRVF

SEQ ID NO: 25775 - protein, 216 aa, Aristolochia fimbriata
MSKLQSDVLREAIGQVMDVAKDKNRNFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVSHQESLESKVNETKAMVKFQLKKVLCMGVAVGNCGMEEKQVFQNVQLSVNFLVSLLKKNWQNVRCLYLKSTMGKPVRVF

SEQ ID NO: 25776 - protein, 216 aa, Liriodendron tulipifera
MSKLQSEALREAITQLVSDAKEKKRNFTETIELQIGLKNYDPQKDKRFSGSVKLPHIPRPKMKVCMLGDAQHVEEAERIGLDYMDVEGLKRMNKNKKLVKKLAKKYHAFLASEAIIKQIPRLLGPGLNKAGKFPTLVSHQESLEAKVNETKAMVKFQLKKVLCMGVAVGNCGMEEKQIFQNVQLSVNFLVSLLKKNWQNVRCLYLKSTMGKPNRIF

SEQ ID NO: 25777 - protein, 216 aa, Vitis vinifera
MSKLQSDALREAITNIVNESKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKAMVKFQLKKVLCMGVAVGNCSMEEKQIFQNVQLSVNFLVSLLKKNWQNVRCLYLKSTMGRSNRVF

SEQ ID NO: 25778 - protein, 216 aa, Lotus japonicus
MSKLQNDAVREAISGIMTDSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQESLEAKVNETKAMVKFQLKKVLCMGVAVGNVSMEEKQIFQNVQLSVNFLVSLLKKNWQNVRCLYLKSTMGKSYRVF

SEQ ID NO: 25779 - protein, 216 aa, Triphysaria pusilla
MSKLQSDALREAITQIVSDCKEKKRNFVETVELQIGLKNYDPQKDKRFSGSVKLPHIPRPKMKICMLGDAQHVEEATKIGLESMDVEALKKLNKNKKLVKKLAKKYHAFLASESVIKQIPRLLGPGLNKAGKFPTLVSHQESLEAKVNETKATIKFQLKKVLCMGVAVGNLDMEEKQIFQNVQMSINFLVSLLKKNWQNVRCLYLKSTMGKTQRIF

SEQ ID NO: 25780 - protein, 216 aa, Arabidopsis lyrata
MSKLQSEAVREAITIITGKSDAKKRNFVETVELQIGLKNYDPQKDKRFSGSVKLPHIPRPKMKICMLGDAQHVEEAEKMGLENMDVESLKKLNKNKKLVKKLAKKYHAFLASESVIKQIPRLLGPGLNKAGKFPTLVSHQESLESKVNETKATVKFQLKKVLCMGVAVGNLSMEEKQIFQNVQMSVNFLVSLLKKNWQNVRCLYLKSTMGPPQRIF

SEQ ID NO: 25781 - protein, 216 aa, Solanum tuberosum
  Sequence also found in Organisms: Solanum phureja
MSKLQSEALREAITVIKNDSAEKKRKFSETIELQIGLKNYDPQKDKRFSGSVKLPHIPRPKMKICMLGDAQHVGEAEKIGLEYMDVEGLKKLNKNKKLVKKLAKKYHAFLASESVIKQIPRLLGPGLNKAGKFPTLVSHQESLESKVNETKATIKFQLKKVLCMGVAVGNMDMEEKQIFQNVQMSVNFLVSLLKKNWQNVRCLYLKSTMGKTQRIF

SEQ ID NO: 25782 - protein, 216 aa, Medicago truncatula
MSKLQSDAVREAITGIMGDSKEKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 25783 - protein, 216 aa, Cephalotaxus harringtonia
MSKLQSDVLREAITGVVAESKEKKRKFVETLELQIGLKNYDPQKDKRFSGSVKLPHIPRPKMKLCMLGDAQHIEEAEKIGLDYMDVEGLKKMNKNKKLVKKLAKKYHAFLASEAIIKQIPRLLGPGLNKAGKFPTLVSHQESLEGKVNETKATIKFQLKKVLCMGVAVGNCGMEEKQIFQNVQLSVNFLVSLLKKNWQNVRCLYLKSTMGKPSRIF

SEQ ID NO: 25784 - protein, 216 aa, Euonymus alatus
MSKLQSDALREAISTIVKDCTEKKRNFVQTIELQIGLKNYDPQKDKRFSGSVKLPHIPRPKMKVCMLGDAQHVEQAEKIGLDYMDVEALKKLNKNKKLVKKLAKKYHAFLASESVIKQIPRLLGPGLNKAGKFPTLVSHQESLESKVNETKATVKFQLKKVLCMGVAVGNVSMEEKQIFQNVQMSVNFLVSLLKKNWQNVKCLYLKSTMGSPNRIF

SEQ ID NO: 25785 - protein, 216 aa, Pteridium aquilinum
MSKLQSDVLREAITQILADSKEKNRKFVETVELQIGLKNYDPQKDKRFSGSVKLAHIPRPKMKVCMLGDAQHVEEAEKIGLDCMDVDALKKMNKNKKLVKKLAKKYHAFLASEAVIKQIPRLLGPGLNKAGKFPTLVQHQESLEGKVNETKATVKFQLKKVLCMGVAVGNLEMEEKQLFQNVQLSVNFLVSLLKKNWQNVRVLYLKTTMGKPVRIF

SEQ ID NO: 25786 - protein, 216 aa, Citrullus lanatus
MSKLQSDALREAISSIFADSSEKKRNFTETIELQIGLKNYDPQKDKRFSGSVKLPHIPRPKMKICMLGDASHVEEAEKIGLDYMDVEGLKKLNKNKKLVKKLAKKYHAFLASEAIIKQIPRLLGPGLNKAGKFPTLVTHQESLESKVNETKAMVKFQLKKVLCMGVAVGNVAMEEKQVFQNVQMSVNFLVSLLKKNWQNVRCLYLKSTMGKAYRVF

SEQ ID NO: 25787 - protein, 216 aa, Fagopyrum esculentum
MSKLSNEALREAVGSIKKDATEKQKKFTETIELQIGLKNYDPQKDKRFSGSVKLPHIPRPKMKVCMLGDAQHVEESEKMGLDSMDVEALKKLNKNKKLVKKLAKKYHAFLASEAVIKQIPRLLGPGLNKAGKFPTLVSHQESLESKVNEIKATVKFQLKKVLCMGVAVGNCGMEEKQIFQNVQMSVNFLVSLLKKNWQNVRCLYLKSTMGKPYRIF

SEQ ID NO: 25788 - protein, 216 aa, Trigonella foenum-graecum
MSKLQSDAVREAITGIMADSKEKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 25789 - protein, 216 aa, Cajanus cajan
MSKLQSDALREAISGIMADSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQETLESKVNESKAMIKFQLKKVLCMGVAVGNVSMEEKQIFQNVQLSVNFLVSLLKKNWQNVRCLYLKSSMGKSYRVF

SEQ ID NO: 25790 - protein, 216 aa, Brassica napus
  Sequence also found in Organisms: Brassica rapa
MSKLQSEALREAITTIKGKSEDKKRNFVETIELQIGLKNYDPQKDKRFSGSVKLPHIPRPKMKVCMLGDAQHVEEAEKMGLDSMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSINFLVSLLKKNWQNVRCLYLKSTMGPPQRIF

SEQ ID NO: 25791 - protein, 216 aa, Eucalyptus grandis
MSKLQSDALREAISGIFSDCNEKKRKFTETIELQIGLKNYDPQKDKRFSGSVKLPHIPRPKMKVCMLGDAQHVEEAEKIGLAYMDVEALKKLNKNKKLVKKLAKKYHAFLASEAVIKQIPRLLGPGLNKAGKFPTLVTHQESLESKVNETKAMVKFQLKKVLCMGVAIGNLSMEEKQVFQNVQLSVNFLVSLLKKNWQNVKCLHLKSTMGKPYRVF

SEQ ID NO: 25792 - protein, 216 aa, Zea mays
MSKLQSESVKDAISQIVGDAKEKNRKFTETVELQIGLKNYDPQKDKRFSGSVKLPHIPRPKMKVCMLGDAQHVEEAEKMGLDYMDVEALKKMNKNKKLVKRLAKKYHAFLASEAIIKQIPRLLGPGLNKAGKFPTLVTHQESLESKVNETKATVKFQLKKVLCMGVAVGNLAMEEKQIQQNIQMSVNFLVSLLKKNWQNVRCLYVKSTMGKPYRVF

SEQ ID NO: 25793 - protein, 216 aa, Medicago truncatula
MSKLQSEAVREAITGIMADSKEKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 25794 - protein, 215 aa, Pseudotsuga menziesii
SKLQSDVLREGISQIMGESNDKKRKFTETIELQIGLKNYDPQKDKRFSGSVKLPHIPRPKMKVCMLGDAQHVEEAEKISLDYMDVEGLKKMNKNKKLVKKLAKKYHAFLASEAIIKQIPRLLGPGLNKAGKFPTLVSHQESLESKVNETKATVKFQLKKVLCMGVAVGNCGMEEKQVFQNVQLSVNFLVSLLKKNWQNVRCLYLKSTMGKPARVF

SEQ ID NO: 25795 - protein, 216 aa, Orobanche aegyptiaca
MSKLQNEALREAITQIVADCKEKKRNFIETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVTHQESLESKVNETKATVKFQLKKVLCMGVAVGNLDMEEKQIFQNVQMSINFLVSLLKKNWQNVKCLYLKSTMGKPQRIF

SEQ ID NO: 25796 - protein, 216 aa, Petunia hybrida
MSKLQSDALREAISVIKKASEDKKRKFTETIELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNLDMDEKQIFQNVQMSVNFLVSLLKKNWQNVRCLYLKSTMGKTQRVF

SEQ ID NO: 25797 - protein, 216 aa, Nicotiana tabacum
MSKLQSDALREAITVIKSASNEKKRKFTETIELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPSLVTHQESLESKVNETKATIKFQLKKVLCMGVAVGNMDMEEKQIFQNVQMSVNFLVSLLKKNWQNVRCLYLKSTMGKTQRVF

SEQ ID NO: 25798 - protein, 216 aa, Actinidia deliciosa
MSKLQSDAVREAISQIAGDAKEKKRKFVETIELQIGLKNYDPQKDKRFSGSVKLPHIPRPKMKVCMLGDAQHVEEAEKIGMDYMDVEGLKKLNKNKKLVKKLAKKYHAFLASEAVIKQIPRLLGPGLNKAGKFPTLVTHQESLESKVNETKATVKFQLKKVLCMGVAVGNCGMEDKQIFQNVQMSVNFLVSLLKKNWQNVRCLSLRSTMGRPARIF

SEQ ID NO: 25799 - protein, 216 aa, Taxus baccata
MSKLQSDVLREAITGVVTESKEKPKKFVETIELQIGLKNYDPQKDKRFSGSVKLPHIPRPKMKLCMLGDAQHVEEAVKIGLDYMDVEGLKKMNKNKKLVKKLAKKYHAFLASEAIIKQIPRLLGPGLNKAGKFPTLVSHQESLEAKMNETKATIKFQLKKVLCMGVAVGNCGMEDKQIFQNVQLSVNFLVSLLKKNWQNVRCLYLKSTMGKPTRIF

SEQ ID NO: 25800 - protein, 216 aa, Solanum melongena
MSKLQSDALREAISVIKNESAEKKRKFSETIELQIGLKNYDPQKDKRFSGSVKLPHIPRPKMKICMLGDAQHVGEAEKIGLEYMDVEGLKKLNKNKKLVKKLAKKYHAFLASESVIKQIPRLLGPGLNKAGKFPTLVSHQESLESKVNETKATIKFQLKKVLCMGVAVGNMDMEEKQIFQNVQMSVNFLVSLLKKNWQNVRCLYLKSTMGKPQRIF

SEQ ID NO: 25801 - protein, 216 aa, Raphanus sativus
MSKLQSEALREAITTIKGKSEEKKRNFTETIELQIGLKNYDPQKDKRFSGSVKLPHIPRPKMKVCMLGDAQHVEEAEKMGLDSMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSINFLVSLLKKNWQNVRCLYLKSTMGPPQRIF

SEQ ID NO: 25802 - protein, 216 aa, Solanum tuberosum
  Sequence also found in Organisms: Solanum phureja
MSKLQSEALREAISIIKNDSAEKKRKFSETIELQIGLKNYDPQKDKRFSGSVRLPHIPRPKMKICMLGDAQHVGEAEKIGLEYMDVESLKKLNKNKKLVKKLAKKYHAFLASESVIKQIPRLLGPGLNKAGKFPTLVSHQESLESKVNETKATIKFQLKKVLCMGVAVGNCDMEEKQIFQNVQMSVNFLVSLLKKNWQNVRCLYLKSTMGKTQRVF

SEQ ID NO: 25803 - protein, 216 aa, Solanum lycopersicum
MSKLQSEALREAISVIKNDSAEKKRKFSETIELQIGLKNYDPQKDKRFSGSVRLPHIPRPKMKICMLGDAQHVGEAEKIGLEYMDVESLKKLNKNKKLVKKLAKKYHAFLASESVIKQIPRLLGPGLNKAGKFPTLVSHQESLESKVNETKATIKFQLKKVLCMGVAVGNCDMEEKQIFQNVQMSVNFLVSLLKKNWQNVRCLYLKSTMGKTQRVF

SEQ ID NO: 25804 - protein, 216 aa, Solanum lycopersicum
MSKLQSEALREAISVIKNDSAEKKRKFSETIELQIGLKNYDPQKDKRFSGSVKLPHIPRPKMKICMLGDAQHVGEAEKIGLEYMDVEGLKKLNKNKKLVKKLAKKYHAFLASESVIKQIPRLLGPGLNKAGKFPTLVSHQESLESKVNETKATIKFQLKKVLCMGVAVGNMDMEEKQIFQNVQMSVNFLVSLLKKNWQNVRCLYLKSTMGKTQRIF

SEQ ID NO: 25805 - protein, 216 aa, Triphysaria pusilla
MSKLQSEALREAITQIVSDCKEKKRNFVETIELQIGLKNYDPQKDKRFSGSVKLPHIPRPKMKICMLGDAQHVEEAAKIGLESMDVEALKKLNKNKKLVKKLAKNYHAFLASESVIKQIPRLLGPGLNKAGKFPTLVSHQESLEAKVNETKATIKFQLKKVLCMGVAVGNLDMEEKQIFQNVQMSINFLVSLLKKNWQNVRCLYLKSTMGKTQRIF

SEQ ID NO: 25806 - protein, 216 aa, Eschscholzia californica
MSKLQSEVLREAITQISGDAKEKARKFTETVELQIGLKNYDPQKDKRFSGSVKLPHIPRPKMKVCMLGDAQHVEEAEKIGLDYMDVEGLKKLNKNKKLVKKLAKRFHAFLASEAVIKQIPRLLGPGLNKAGKFPTLVSHQESLEAKVNETKAMVKFQLKKVLCMGVAVGNLGMEEKQIFQNVQLSVNFLVSLLKKNWQNVRCLYLKSTMGKPVRIF

SEQ ID NO: 25807 - protein, 217 aa, Tabernaemontana elegans
MSKLQSDAVREAISQIVSDSKGEKKRKFTETIELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNLDMEEKQIFQNVQMSVNFLVSLLKKNWQNVRCLYLKSTMGRPQRIF

SEQ ID NO: 25808 - protein, 216 aa, Bupleurum chinense
MSKLQSEALREAISQITKEAVEKKRNFTETIELQIGLKNYDPQKDKRFSGSVKLPHIPRPKMKVCMLGDAQHVGEAEKIGLEYMDVEGLKKLNKNKKLVKKLAKKYHAFLASEAVIKQIPRLLGPGLNKAGKFPTLVSHQESLEAKVNETKATVKFQLKKVLCMGVAVGNCSMEEKQIFQNVQMSVNFLVSLLKKNWQNVRCLYLKSTMGKTVRIF

SEQ ID NO: 25809 - protein, 216 aa, Catharanthus roseus
MSKLQSDALREAISQIKNDADAKKRNFTETVELQIGLKNYDPQKDKRFSGSVRLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNCAMEEKQIFQNVQMSVNFLVSLLKKNWQNVRCLYLKSTMGKPQRIF

SEQ ID NO: 25810 - protein, 216 aa, Gossypium hirsutum
MSKLQSDALREAISTIVANSKEKNRKFTETIELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRIF

SEQ ID NO: 25811 - protein, 216 aa, Platanus occidentalis
MSKLQSDVLREAIGQVMGAAKEKNRKFTETLELQIGLKNYDPQKDKRFSGSVKLPHIPRPKMKVCMLGDAQHVEEAERIGLESMDVEALKKMNKNKKLVKKLAKKYHAFLASEAIIKQIPRLLGPGLNKAGKFPTLVSHQESLESKVNETKAMVKFQLKKVLCMGVAVGNCGMDEKQVFQNVQLSVNFLVSLLKKNWQNVRCLYLKSTMGKPYRIF

SEQ ID NO: 25812 - protein, 216 aa, Pteridium aquilinum
MSKLQSDALREAISTIVAQVQGKNRKFTETIELQIGLKNYDPQKDKRFSGSVKLPHIPRPKMKICMLGDAQHVEEAEKIGLDYMDVEALKKLNKNKKLVKKLAKKYQAFLASEAIIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRIF

SEQ ID NO: 25813 - protein, 216 aa, Amsonia hubrichtii
MSKLQSDALREAISVVKNDAAEKKRNFTETIELQIGLKNYDPQKDKRFSGSVKLPHIPRPKMKACMLGDAQHVEEAEKIGLEYMDVEGLKKLNKNKKLVKKLAKKYHAFLASEAVIKQIPRLLGPGLNKAGKFPTLVTHQESLESKVNEIKATVKFQLKKVLCMGVAVGNCDMEEKQIFQNVQMSVNFLVSLLKKNWQNVRCLYLKSTMGKPQRIF

SEQ ID NO: 25814 - protein, 217 aa, Eutrema halophilum
  Sequence also found in Organisms: Eutrema parvulum
MSKLQSEALREAISAIVTHCKETKPRKFTETIELQIGLKNYDPQKDKRFSGSVKLPHIPRPKMKICMLGDAQHVEEAEKIGLDSMDVEALKKLNKNKKLVKKLAKKFQAFLASESVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMGPPNRVF

SEQ ID NO: 25815 - protein, 216 aa, Euonymus alatus
MSKLQSDALREAISTIVKECAEKKRNFVQTIELQIGLKNYDPQKDKRFSGSVKLPHIPRPKMKVCMLGDAQHVEEAEKIGLDYMDVEALKKLNKNKKLVKKLAKKHHAFLASESVIKQIPRLLGPGLNKAGKFPTLVSHQESLESKINETKATVKFQLKKVLCMGVAVGNVSMEEKQIFQNVQMSVNFLVSLLKKNWQNVRCLYLKSTMGSPNRIF

SEQ ID NO: 25816 - protein, 216 aa, Tripterygium wilfordii
MSKLQSDALREAIATIVKESTEKKRNFVQTIELQIGLKNYDPQKDKRFSGSVKLPHIPRPKMKVCMLGDAQHVEEAEKIGLDYMDVEALKKLNKNKKLVKKLAKKHHAFLASESVIKQIPRLLGPGLNKAGKFPTLVSHQESLESKVNETKATVKFQLKKVLCMGVAVGNVSMEEKQIFQNVQMSVNFLVSLLKKNWQNVRCLYLKSTMGSPNRIF

SEQ ID NO: 25817 - protein, 216 aa, Tripterygium wilfordii
MSKLQSDALREAISTIVKESAEKKRNFVQTIELQIGLKNYDPQKDKRFSGSVKLPHIPRPKMKVCMLGDAQHVEEAEKMGLDYMDVEALKKLNKNKKLVKKLAKKYHAFLASESVIKQIPRLLGPGLNKAGKFPTLVSHQESLESKVNETKAMVKFQLKKVLCMGVAVGNVSMEEKQIFQNVQMSVNFLVSLLKKNWQNVKCLYLKSTMGSPNRIF

SEQ ID NO: 25818 - protein, 216 aa, Platanus occidentalis
MSKLQSDVLREAIGQIMGAAKEKNRKFTETIELQIGLKNYDPQKDKRFSGSVKLPHIPRPKMKVCMLGDAQHVEEAERMGLESMDVEALKKMNKNKKLVKKLAKKYHAFLASEAIIKQIPRLLGPGLNKAGKFPTLVSHQESLESKVNETKAMVKFQLKKVLCMGVAVGNCDMDEKQVFQNVQLSVNFLVSLLKKNWQNVRCLNLKTTMGKPYRIF

SEQ ID NO: 25819 - protein, 216 aa, Citrullus lanatus
MSKLQSDALREAISSIFTDSNEKKRKFTETIELQIGLKNYDPQKDKRFSGSVKLPHIPRPKMKICMLGDASHVEEAEKIGLDYMDVEGLKKLNKNKKLVKKLAKKYHAFLASEAIIKQIPRLLGPGLNKAGKFPTLVTHQETLESKVNETKAMVKFQLKKVLCMGVAVGNVAMDEKQVFQNVQMSVNFLVSLLKKNWQNVRCLYLKSTMGKSYRVF

SEQ ID NO: 25820 - protein, 216 aa, Picea glauca
MSKLQSDVLREGITQVMGESKDKKRKFTETIELQIGLKNYDPQKDKRFSGSVKLPHIPRPKMKVCMLGDAQHIEEAEKISLDYMDVEGLKKMNKNKKLVKKLAKKYHAFLASEAIIKQIPRLLGPGLNKAGKFPTLVSHQESLESKVNETKATVKFQLKKVLCMGVAVGNCGMEEKQVFQNVQLSVNFLVSLLKKNWQNVRCLYLKSTMGKPARVF

SEQ ID NO: 25821 - protein, 217 aa, Citrus clementina
  Sequence also found in Organisms: Citrus sinensis
MSKLQSDALREAVSSIVQYSKETKKRNFTETIELQIGLKNYDPQKDKRFSGSVKLPHIPRPKMKVCMLGDAQHVEEAEKIGLDYMDVEGLKKLNKNKKLVKKLAKKYHAFLASESVIKQIPRLLGPGLNKAGKFPTLVTHQESLESKVNETKATVKFQLKKVLCMGVAVGNLSMEEKQIFQNVQMSVNFLVSLLKKNWQNVRCLYLKSTMGPSNRIF

SEQ ID NO: 25822 - protein, 217 aa, Scabiosa columbaria
MSKLQSEALREAISQIATAAAGENKRNFVETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNEIKATVKFQLKKVLCMGVAVGNCSMEEKQIFQNVQMSVNFLVSLLKKNWQNVRCLYLKSTMGKPVRIF

SEQ ID NO: 25823 - protein, 218 aa, Vinca minor
MSKLQSDAVREAITQIVTDCNKEDKKRKFTETVELQIGLKNYDPQKDKRFSGSVKLPHIPRPKMKVCMLGDAQHVGEAEKIGLEYMDVEGLKKLNKNKKLVKKLAKKYHAFLASEAVIKQIPRLLGPGLNKAGKFPTLVSHQESLESKVNEIKATVKFQLKKVLCMGVAVGNLDMEEKQIFQNVQMSVNFLVSLLKKNWQNVRCLYLKSTMGRPQRIF

SEQ ID NO: 25824 - protein, 216 aa, Triticum aestivum
MSKLQTDALKEAITQVVADAKEKNRKFTETVELQIGLKNYDPQKDKRFSGSVKLPHVPRPKMRVCMLGDAQHVGEAEKIGLDSMDVEALKKMNKNKKLVKRLAKKYHAFLASEAIIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 25825 - protein, 216 aa, Brassica juncea
  Sequence also found in Organisms: Raphanus sativus
MSKLQSEALREAITTIKGKSEEKKRNFTETVELQIGLKNYDPQKDKRFSGSVKLPHIPRPKMKVCMLGDAQHVEEAEKMGLDSMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSINFLVSLLKKNWQNVRCLYLKSTMGPPQRIF

SEQ ID NO: 25826 - protein, 216 aa, Brachypodium distachyon
MSKLQSEAVKDAITQIVGDAREKKRKFTETVELQIGLKNYDPQKDKRFSGSVKLPHIPRPKMRVCMLGDAQHVDQAEKLGLACMDVESLKKMNKNKKLVKKLAKKYHAFLASEAIIKQIPRLLGPGLNKAGKFPTLVSHQESLEAKVNETKATIKFQLKKVLCMGVAVGNLSMDEKQIQQNIQMSVNFLVSLLKKNWQNVRCLYVKSTMGKRVRVF

SEQ ID NO: 25827 - protein, 216 aa, Gossypium raimondii
MSKLQSDALREAISTIVANSKEKSRKFTETIELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRIF

SEQ ID NO: 25828 - protein, 216 aa, Gossypium hirsutum
  Sequence also found in Organisms: Gossypium raimondii
MSKLQSDALREAISTIVAQSKEKQRKFTETIELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRIF

SEQ ID NO: 25829 - protein, 216 aa, Gossypium hirsutum
  Sequence also found in Organisms: Gossypium raimondii
MSKLQSDALREAISTIVTQSKEKQRKFTETIELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRIF

SEQ ID NO: 25830 - protein, 216 aa, Vitis vinifera
MSKLQSEALREAITQIVGDAKEKKRNFIETIELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNETKAMVKFQLKKVLCMGVAVGNCSMEEKQIFQNVQLSVNFLVSLLKKNWQNVRCLYLKSTMGKSNRIF

SEQ ID NO: 25831 - protein, 216 aa, Medicago truncatula
MSKLQSEAVREAISGIMADSKEKNRKFVETIELQIGLKNYDPQKDKRFSGSVKLPHIPRPKMKLCMLGDAQHVEEAEKIGLESMDVEALKKLNKNKKLVKKLAKKYHAFLASEAVIKQIPRLLGPGLNKAGKFPTLVSHQESLEGKVNETKAMVKFQLKKVLCMGVAVGNVSMDEKQIFQNVQLSVNFLVSLLKKNWQNVRCLYLKSSMGKSYRVF

SEQ ID NO: 25832 - protein, 216 aa, Cynodon dactylon
MSKLQTEVLKDGIPNVLQDAQEKNRKFPETIELPIGPQNYDPQKDKRFSGSVKLPHIPRPKMKVCMLGDAQHVEEAEKMGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRLF

SEQ ID NO: 25833 - protein, 216 aa, Avena sativa
MSKLSSDAVKEAITQIVGEAREKKRKFTETVELQIGLKNYDPQKDKRFSGSVKLPHIPRPKMRVCMLGDAQHVDQAEKLGLDSMDVESLKKMNKNKKLVKKLAKKYHAFLASEAIIKQIPRLLGPGLNKAGKFPTLVSHSESLEAKVNETKATVKFQLKKVLCMGVAVGNLSMDEKQIQQNLQMSVNFLVSLLKKNWQNVRCLYVKSTMGKRIRVF

SEQ ID NO: 25834 - protein, 216 aa, Carica papaya
MSKLQSDALREAISTVVNASKEKKRNFTETIELQIGLKNYDPQKDKRFSGSVKLPHIPRPKMKVCMLGDAQHVEEAEKIGLDYMDVEGLKKLNKNKKLVKKLAKKYHAFLASESVIKQIPRLLGPGLNKAGKFPTLVTHQESLESKVNEIKATVKFQLKKVLCMGVAVGNCAMEEKQIFQNVQMSVNFLVSLLKKNWQNVRCLYLKSTMGPSNRVF

SEQ ID NO: 25835 - protein, 216 aa, Ocimum basilicum
MSKLSGDATREAISQIVSECKEKKRNFTETIELQIGLKNYDPQKDKRFSGSVKLPHIPRPKMKICMLGDAQHVEEAEKIGMESMDVEALKKLNKNKKLVKKLAKKYHAFLASEAVIKQIPRLLGPGLNKAGKFPTLVSHQESLESKVNETKATVKFQLKKVLCMGVAVGNLDMEEKQIFQNVQMSVNFLVSLLKKNWQNVRCLYLKSTMGKPQRIF

SEQ ID NO: 25836 - protein, 216 aa, Adiantum capillus-veneris
MSKLQSDVLREAITQLVSESKEKKRKFVETVELQIGLKNYDPQKDKRFSGSVKLAHIPRPKMKVCMLGDAQHVEEAEKIGLDCMDVDALKKMNKNKKLVKKLAKKYHAFLASEAVIKQIPRLLGPGLNKAGKFPTLVSHQESLEGKLNETKATVKFQLKKVLCMGVAVGNLEMEEKQLFQNVQLSVNFLVSLLKKNWQNVRVLYLKSTMGKPQRIF

SEQ ID NO: 25837 - protein, 216 aa, Tropaeolum majus
MSKLQSEALREAITTIVTASKEKQRKFTETIELQIGLKNYDPQKDKRFSGSVKLPHIPRPKMKACMLGDAQHVEEAEKIGLDYMDVEALKKLNKNKKLVKKLAKKYHAFLASESVIKQIPRLLGPGLNKAGKFPTLVSHQESLEAKVNEIKATVKFQLKKVLCMGVAVGNCAMEEKQIFQNVQMSVNFLVSLLKKNWQNVRCLYLKSTMGPSNRVF

SEQ ID NO: 25838 - protein, 216 aa, Raphanus sativus
MSKLQSEAVKEAITVIRGKSEEKKRNFVETLELQIGLKNYDPQKDKRFSGSVKLPHIPRPKMKICMLGDAQHVEEAEKMGLDSMDVESLKKLNKNKKLVKKLAKKYHAFLASESVIKQIPRLLGPGLNKAGKFPTLVSHQESLEGKVNETKATVKFQLKKVLCMGVAVGNLSMEEKHIFQNVQMSVNFLVSLLKKNWQNVRCLYLKSTMGPPQRIF

SEQ ID NO: 25839 - protein, 216 aa, Amborella trichopoda
MSKLQSDTLREVIGKVMGDAKKKNRKFTETIELQIGLKNYDPQKDKRFSGSVKLPHVPRPKMKVCMLGDAQHVEEAEKMGLDYMDVEGLKKLNKNKKLVKKLAKKYHAFLASEAVIKQIPRLLGPGLNKAGKFPTLVSHQESLESKVNETKAIVKFQLKKVLCMGVAVGNCAMEEKQVFQNVQMSVNFLVSLLKKNWQNVRSLYLKSTMGKAHPLF

SEQ ID NO: 25840 - protein, 216 aa, Secale cereale
MSKLQSEAVKDAITQIVGEAREKKRKFTETVELQIGLKNYDPQKDKRFSGSVKLPHIPRPKMRVCMLGDAQHVDQAEKMGLDYMDVESLKKMNKNKKLVKKLAKKYHAFLASEAIIKQIPRLLGPGLNKAGKFPTLVSHQESLEAKVNETKATIKFQLKKVLCMGVAVGNLSMDEKQIQQNIQMSVNFLVSLLKKNWQNVRCLYVKSTMGKRVRVF

SEQ ID NO: 25841 - protein, 216 aa, Chelidonium majus
MSKLQSEVLREAITQINGEAKEKKRNFTETVELQIGLKNYDPQKDKRFSGSVKLPHIPRPKMKVCMLGDAQHVEEAEKIGLAYMDVEGLKKLNKNKKLVKKLAKKYHAFLASEAVIKQIPRLLGPGLNKAGKFPTLVTHQESLESKVNETKAMVKFQLKKVLCMGVAVGNLGMEEKQIFQNVQLSVNFLVSLLKKNWQNVRCLYLKSTMGKPVRIF

SEQ ID NO: 25842 - protein, 216 aa, Humulus lupulus
MSKLQSEVLREAIATIMNESREKKRNFTETIELQIGLKNYDPQKDKRFSGSVKLPHIPRPKMKVCMLGDAQHVEEAEKIGLDYMDVEGLKKLNKNKKLVKKLAKKYHAFLASEAVIKQIPRLLGPGLNKAGKFPTLVTHQESLESKVNETKAMVKFQLKKVLCMGVAVGNLSMEEKQVFQNVQMSVNFLVSLLKKNWQNVRCLFLKTTMGKPQRVF

SEQ ID NO: 25843 - protein, 216 aa, Beta vulgaris
MSKLQGEAVREAISGIANDAKEKNRKFTETIELQIGLKNYDPQKDKRFSGSVKLPHIPRPKMKVCMLGDAQHVEEAERIGLEWMDVEALKKLNKNKKLVKKLAKKYHAFLASEAVIKQIPRLLGPGLNKAGKFPTLVTHQEPLENKVNEIKATVKFQLKKVLCMGVAVGNCSMEEKQIFQNVQMSVNFLVSLLKKNWQNVRCLYLKSTMGKPYRIF

SEQ ID NO: 25844 - protein, 216 aa, Gossypium hirsutum
MSKLQSDALREAISTIVAQSKEKQRKFIETIELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRIF

SEQ ID NO: 25845 - protein, 216 aa, Eutrema halophilum
MSKLQSEALREAITTVKSKSEDKKRNFVETVELQIGLKNYDPQKDKRFSGSVKLPHIPRPKMKICMLGDAQHVEEAEKMGLDYMDVEALKKLNKNKKLVKKLAKKYHAFLASESVIKQIPRLLGPGLNKAGKFPTLVSHQESLESKVNETKATVKFQLKKVLCMGVAVGNLSMEEKQLFQNVQMSVNFLVSLLKKNWQNVRCLYLKSTMGPPQRIF

SEQ ID NO: 25846 - protein, 216 aa, Cucurbita pepo
MSKLQSEALREAISSIFTDSNEKKRNFTETIELQIGLKNYDPQKDKRFSGSVKLPHIPRPKMKLCMLGDALHVEEAEKIGLDYMDVEGLKKLNKNKKLVKKLAKKYHAFLASEAVIKQIPRLLGPGLNKAGKFPTLVTHQESLESKVNETKAMVKFQLKKVLCMGVAVGNVAMEEKQVFQNVQMSVNFLVSLLKKNWQNVRCLYLKSTMGKSYRVF

SEQ ID NO: 25847 - protein, 216 aa, Cucurbita pepo
MSKLQSEALREAISSIFGDSSEKKRNFTETIELQIGLKNYDPQKDKRFSGSVKLPHIPRPKMKICMLGDALHVEEAEKIGLDYMDVEGLKKLNKNKKLVKKLAKKYHAFLASEAVIKQIPRLLGPGLNKAGKFPTLVTHQESLESKVNETKAMVKFQLKKVLCMGVAVGNVAMEEKQVFQNVQMSVNFLVSLLKKNWQNVRCLYLKSTMGKAYRVF

SEQ ID NO: 25848 - protein, 216 aa, Euonymus alatus
MSKLQSDALREAITTIVKESTEKKKNFVQTIELQIGLKNYDPQKDKRFSGSVKLPHIPRPKMKVCMLGDAQHVEQAEKIGLDYMDVEALKKLNKNKKLVKKLAKKYHAFLASESVIKQIPRLLGPGLNKAGKFPTLVSHQESLESKVNETKATVKFQLKKVLCMGVAVGNVSMEEKQIFQNVQMSVNFLVSLLKKNWQNVKCLYLKSTMGSPNRIF

SEQ ID NO: 25849 - protein, 216 aa, Brassica napus
MSKLQSEALREAITTIKGKSEDKKRNFVETVELQIGLKNYDPQKDKRFSGSVKLPHIPRPKMKVCMLGDAQHVEEAEKMGLDSMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSINFLVSLLKKNWQNVRCLYLKSTMGPPQRIF

SEQ ID NO: 25850 - protein, 216 aa, Trigonella foenum-graecum
MSKLQSEAVREAISGIMGDSKEKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEGKVNETKAMVKFQLKKVLCMGVAVGNVSMDEKQIFQNVQLSVNFLVSLLKKNWQNVRCLYLKSSMGKSYRVF

SEQ ID NO: 25851 - protein, 216 aa, Pinus pinaster
MSKLQSDVLREGITQVMGESKDKKRKFTETIELQIGLKNYDPQKDKRFSGSVKLPHIPRPKMKVCMLGDAQHVEEAEKISLDYMDVEGLKKMNKNKKLVKKLAKKYHAFLASEAIIKQIPRLLGPGLNKAGKFPTLVSHQESLEAKVNETKAMVKFQLKKVLCMGVAVGNCGMEEKQVFQNVQLSVNFLVSLLKKNWQNVRCLYLKSTMGKPARVF

SEQ ID NO: 25852 - protein, 218 aa, Vinca minor
MSKLQSDAVREAISQIVADCNKEDKKRKFTETVELQIGLKNYDPQKDKRFSGSVKLPHIPRPKMKVCMLGDAQHVGEAEKIGLEYMDVEGLKKLNKNKKLVKKLAKKYHAFLASEAVIKQIPRLLGPGLNKAGKFPTLVSHQESLESKVNEIKATVKFQLKKVLCMGVAVGNLSMEEKQIFQNVQMSVNFLVSLLKKNWQNVRCLYLKSTMGRPQRIF

SEQ ID NO: 25853 - protein, 217 aa, Brassica napus
  Sequence also found in Organisms: Brassica rapa
MSKLQSEAVREAISSMITHCKETKPRKFTETIELQIGLKNYDPQKDKRFSGSVKLPHIPRPKMKICMLGDAQHVEEAEKIGLDSMDVEALKKLNKNKKLVKKLAKKFHAFLASESVIKQIPRLLGPGLNKAGKFPTLVSHQESLEAKVNETKATVKFQLKKVLCMGVAVGNLGMEEKQIFQNVQMSVNFLVSLLKKNWQNVRCLYLKSTMGPPNRVF

SEQ ID NO: 25854 - protein, 217 aa, Coffea canephora
MSKLQSDAVREAIGVIMTEAKGDKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNCDMEEKQIFQNVQMSVNFLVSLLKKNWQNVRCLYLKSTMGKPNRIF

SEQ ID NO: 25855 - protein, 217 aa, Raphanus sativus
MSKLQSEAVREAISSIITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMSPPTRVF

SEQ ID NO: 25856 - protein, 217 aa, Valeriana officinalis
MSKLQSEALREAITQIAGDARGDKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNEIKATVKFQLKKVLCMGVAVGNCAMDDKQIFQNVQMSVNFLVSLLKKNWQNVRCLYLKSTMGKPQRIF

SEQ ID NO: 25857 - protein, 216 aa, Aquilegia formosa
MSKLQSDVLREGISQIVNESKQKERKFVGTIELQIGLKNYDPQKDKRFSGSVKLPHIPRPKMKVCMLGDAQHVEEAEKIGLEYMDVEGLKKLNKNKKLVKKLAKKFHAFLASEAVIKQIPRLLGPGLNKAGKFPTLVTHQESLESKVNETKAMVKFQLKKVLCMGVAVGNLGMDEKQIFQNVQLSVNFLVSLLKKNWQNVRCLYLKSTMGKPFRIF

SEQ ID NO: 25858 - protein, 216 aa, Amborella trichopoda
MSKLQSDTLREVISKVVGDAKRKPRKFTETIELQIGLKNYDPQKDKRFSGSVKLPHIPRPKMKLCMLGDAQHVEEAEKMGLDYMDVEGLKKMNKNKKLVKKLAKKYHAFLASEAVIKQIPRLLGPGLNKAGKFPTLVSHQESLEAKVNETKAIVKFQLKKVLCMGVAVGNCAMEEKQVFQNVQMSVNFLVSLLKKNWQNVRCLYLKSTMGRAHPLF

SEQ ID NO: 25859 - protein, 216 aa, Eucalyptus grandis
MSKLQSEALREAITGIKNDCNEKKRNFTETIELQIGLKNYDPQKDKRFSGSVKLPHIPRPKMKVCMLGDAQHVEEAEKIGLDYMDVEGLKKLNKNKKLVKRLAKKYHAFLASEAVIKQIPRLLGPGLNKAGKFPTLVTHQESLDAKVNEMKAMVKFQLKKVLCMGVAVGNLSMEDKQIFQNVQLSVNFLVSLLKKNWQNVKCLYLKSSMGKPYRVF

SEQ ID NO: 25860 - protein, 216 aa, Amaranthus tuberculatus
MSKLQSEAVREAITGIKTDSAEKGRKFTETIELQIGLKNYDPQKDKRFSGSVKLPHIPRPKMKVCMLGDAQHVEEAERIGLEWMDVEALKKLNKNKKLVKKLAKKYHAFLASEAVIKQIPRLLGPGLNKAGKFPTLVTHQEPLENKVNEIKATVKFQLKKVLCMGVAVGNCSMEEKQVFQNVQMSVNFLVSLLKKNWQNVRCLYLKSTMGKPYRIF

SEQ ID NO: 25861 - protein, 216 aa, Setaria italica
MSKLQTEVLKDAISQVVSEAREKNRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPNRVF

SEQ ID NO: 25862 - protein, 216 aa, Pseudoroegneria spicata
MSKLQTDVLKEAITQVVADAKEKNRKFTETVELQIGLKNYDPQKDKRFSGSVKLPHVPRPKMRVCMLGDAQHVGEAEKIGLDAMDVEALKKMNKNKKLVKRLAKKYHAFLASEAIIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 25863 - protein, 216 aa, Glycine max
MSKLQSDALREAISQVVSNSKEKNRKFTETIELQIGLKNYDPQKDKRFSGSVKLPHIPRPKMKICMLGDAQHVEEAEKIGLDYMDVEALKKLNKNKKLVKKLAKKYHVFLASEAVIKQIPRLLGPGLNKAGKFPTLVTHQESLESKVNETKAMVKFQLKKVLCMGVAVGNCTMEEKQIFQNVQLSVNFLVSLLKKNWQNVRCLYLKSTMGSAIRVF

SEQ ID NO: 25864 - protein, 216 aa, Pinus taeda
MSKLQSDVLREGISQVMGESKDKKRKFTETIELQIGLKNYDPQKDKRFSGSVKLPHIPRPKMKVCMLGDAQHVEEAEKISLDYMDVEGLKKMNKNKKLVKKLAKKYHAFLASEAIIKQIPRLLGPGLNKAGKFPTLVSHQESLEAKVNETKAMVKFQLKKVLCMGVAVGNCGMEEKQVFQNVQLSVNFLVSLLKKNWQNVRCLYLKSTMGKPARVF

SEQ ID NO: 25865 - protein, 216 aa, Heritiera littoralis
MSKLQSDALREAISTIVAQSKERQRKFTETIELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVTHQESLESKVNETKAMVKFQLKKVLCMGVAVGNVAMEEKQIFQNVQMSVNFLVSLLKKNWQNVRCLYLKSTMGPSNRVF

SEQ ID NO: 25866 - protein, 216 aa, Ipomoea nil
MSKLQSDAVREAISQLMGDSKEKNRKFTETIELQIGLKNYDPQKDKRFSGSVKLPHIPRPKMKVCMLGDAQHVEEAEKIGMEYMDVEGLKKLNKNKKLVKKLAKKYHAFLASEAVIKQIPRLLGPGLNKAGKFPTLVTHQESLETKVNETKATVKFQLKKVLCMGVAVGNVAMEEKQIFQNVQMSVNFLVSLLKKNWQNVRCLYLKTTMGRPIRVF

SEQ ID NO: 25867 - protein, 216 aa, Ipomoea batatas
MSKLQSDAVREAISQLMGDSKEKNRKFTETIELQIGLKNYDPQKDKRFSGSVKLPHIPRPKMKVCMLGDAQHVEEAEKFGMEYMDVEGLKKLNKNKKLVKKLAKKYHAFLASEAVIKQIPRLLGPGLNKAGKFPTLVTHQESLETKVNETKATVKFQLKKVLCMGVAVGNVAMEEKQIFQNVQMSVNFLVSLLKKNWQNVRCLYLKTTMGRPIRIF

SEQ ID NO: 25868 - protein, 216 aa, Tropaeolum majus
MSKLQSEALREAISTIMTASKEKQRNFTETIELQIGLKNYDPQKDKRFSGSVKLPHIPRPKMKACMLGDAQHVEEATKIGLDYMDVEALKKLNKNKKLVKKLAKKYHAFLASESVIKQIPRLLGPGLNKAGKFPTLVSHQESLEAKVNEIKATVKFQLKKVLCMGVAVGNCGMEEKQIFQNVQMSVNFLVSLLKKNWQNVRCLYLKSTMGPSNRVF

SEQ ID NO: 25869 - protein, 216 aa, Cichorium intybus
MSKLASEAVREAITQITTDAKEKNRKFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLESKVNETKATVKFQLKKVLCMGVAVGNCSMEEKQIFQNVQMSVNFLVSLLKKNWQNVRCLYLKTTMGKPVRVF

SEQ ID NO: 25870 - protein, 216 aa, Taraxacum officinale
MSKLQSEALREAITQITTDAKEKSRKFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 25871 - protein, 216 aa, Cichorium intybus
MSKLQSDALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 25872 - protein, 216 aa, Humulus lupulus
MSKLSSDAVREGIAQIVINSKEKNRKFTETIELQIGLKNYDPQKDKRFSGSVKLPHIPRPKMKICMLGDAQHVEEAEKIGLDYMDVEGLKKLNKNKKLVKKLAKKFHAFLASEAVIKQIPRLLGPGLNKAGKFPTLVTHQESLESKVNETKAMVKFQLKKVLCMGVAVGNLSMEEKQIFQNVQMSVNFLVSLLKKNWQNVRCLYLKSTMGSAIRIF

SEQ ID NO: 25873 - protein, 216 aa, Cucurbita pepo
MSKLQSEALREAISSIFGDSTEKKRNFTETIELQIGLKNYDPQKDKRFSGSVKLPHIPRPKMKLCMLGDALHVEEAEKIGMDYMDVEGLKKLNKNKKLVKKLAKKYHAFLASEAVIKQIPRLLGPGLNKAGKFPTLVTHQESLESKVNETKAMVKFQLKKVLCMGVAVGNVAMEEKQVFQNVQMSVNFLVSLLKKNWQNVRCLYLKSTMGKAYRVF

SEQ ID NO: 25874 - protein, 216 aa, Arnica chamissonis
MSKLQSEALREAITQITTDAREKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 25875 - protein, 216 aa, Ambrosia trifida
MSKLQSEALREAITQITTDAKEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 25876 - protein, 216 aa, Ambrosia trifida
MSKLQSEALREAITQITTDAREKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQVPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 25877 - protein, 216 aa, Flaveria ramosissima
MSKLQSDALREAITQITTDAKEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVTHQESLEAKVNETKATVKFQLKKVLCMGVAVGNCSMEEKQIFQNVQMSVNFLVSLLKKNWQNVRCLYLKTTMGKPVRIF

SEQ ID NO: 25878 - protein, 218 aa, Plantago ovata
MSKLSSDATKEAITSIMADATDPEKKKNFTETIELQIGLKNYDPQKDKRFSGSVKLPHIPRPKMKICMLGDAQHVEEAEKIGLESMDVEALKKLNKNKKLVKKLAKKYHAFLASESVIKQIPRLLGPGLNKAGKFPTLVSHQESLESKVNETKATVKFQLKKVLCMGVAVGNCGMEEKQIFQNVQMSVNFLVSLLKKNWQNVRCLYLKSTMGKPVRIF

SEQ ID NO: 25879 - protein, 216 aa, Aquilegia formosa
MSKLQSDVLREGITQITNGAKEKKRNFTETVELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNESKAMVKFQLKKVLCMGVAVGNLGMDEKQIFQNVQLSVNFLVSLLKKNWQNVRCLYLKSSMGKPVRIF

SEQ ID NO: 25880 - protein, 216 aa, Arnica chamissonis
  Sequence also found in Organisms: Cichorium intybus, Taraxacum officinale, Lactuca sativa, Helianthus annuus
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 25881 - protein, 216 aa, Arabidopsis thaliana
MSKLQSEAVREAITTIKGKSEEKKRNFVETVELQIGLKNYDPQKDKRFSGSVKLPHIPRPKMKICMLGDAQHVEEAEKMGLSNMDVEALKKLNKNKKLVKKLAKSYHAFLASESVIKQIPRLLGPGLNKAGKFPTLVSHQESLEAKVNETKATVKFQLKKVLCMGVAVGNLSMEEKQLFQNVQMSVNFLVSLLKKNWQNVRCLYLKSTMGPPQRIF

SEQ ID NO: 25882 - protein, 216 aa, Echinacea purpurea
  Sequence also found in Organisms: Flaveria ramosissima
MSKLQSDALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEEKQIFQNVQMSVNFLVSLLKKNWQNVRCLYLKTTMGKPVRIF

SEQ ID NO: 25883 - protein, 216 aa, Festuca arundinacea
  Sequence also found in Organisms: Lolium multiflorum
MSKLSSDAVKEAIALIVGEAREKKRKFTETVELQIGLKNYDPQKDKRFSGSVKLPHIPRPKMRVCMLGDASHVDQAEKLGLDSMDVESLKKMNKNKKLVKKLAKKYHAFLASEAIIKQIPRLLGPGLNKAGKFPTLVSHSESLEAKVNETKATVKFQLKKVLCMGVAVGNLSMDEKQIQQNLQMSVNFLVSLLKKNWQNVRCLYVKSTMGKRQRVF

SEQ ID NO: 25884 - protein, 216 aa, Avena sativa
MSKLSSEAVKDAITQIVGEAREKKRKFTETVELQIGLKNYDPQKDKRFSGSVKLPHIPRPKMRVCMLGDAQHVDQAEKLGLDSMDVESLKKMNKNKKLVKKLAKKYHAFLASEAIIKQIPRLLGPGLNKAGKFPTLVSHSESLEAKVNETKATVKFQLKKVLCMGVAVGNLSMDEKQIQQNLQMSVNFLVSLLKKNWQNVRCLYVKSTMGKRVRVF

SEQ ID NO: 25885 - protein, 216 aa, Brachypodium distachyon
MSKLQTEALKEAITQVVTEAKEKNRKFTETVELQIGLKNYDPQKDKRFSGSVKLPHVPRPKMRVCMLGDAQHVGEAEKIGLDSMDVEALKKMNKNKKLVKRLAKKYHAFLASEAIIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 25886 - protein, 216 aa, Arachis hypogaea
MSKLQSDALREAISQLVANANEKKRKFTETVELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQESLESKVNETKAMVKFQLKKVLCMGVAVGNCSMEEKQIFQNVQLSVNFLVSLLKKNWQNVRCLYLKSTMGSAIRVF

SEQ ID NO: 25887 - protein, 217 aa, Brassica napus
  Sequence also found in Organisms: Brassica oleracea
MSKLQSEAVKEAISTIITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMSPPTRVF

SEQ ID NO: 25888 - protein, 216 aa, Cucumis sativus
  Sequence also found in Organisms: Cucumis melo
MSKLQSDALREAISSIFTDSNEKKRKFTETIELQIGLKNYDPQKDKRFSGSVKLPHIPRPKMKICMLGDASHIEEAEKIGLEYMDVEGLKKLNKNKKLVKKLAKKYHAFLASESIIKQIPRLLGPGLNKAGKFPTLVTHQETLESKVNETKAMVKFQLKKVLCMGVAVGNVSMDEKQVFQNVQMSVNFLVSLLKKNWQNVRCLYLKSTMGKSYRVF

SEQ ID NO: 25889 - protein, 216 aa, Trifolium pratense
MSKLQSEAVREAISGIMTDSKDKNRKFVETIELQIGLKNYDPQKDKRFSGSVKLPHIPRPKMKICMLGDAQHVEEAEKIGLESMDVEALKKLNKNKKLVKKLAKKYQAFLASEAVIKQIPRLLGPGLNKAGKFPTLVSHQESLEGKVNETKAMVKFQLKKVLCMGVAVGNVSMDEKQIFQNVQLSVNFLVSLLKKNWQNVRCLYLKSSMGKSYRVF

SEQ ID NO: 25890 - protein, 215 aa, Parthenium argentatum
MSKLQSEALREAITQITTDAKEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRI

SEQ ID NO: 25891 - protein, 216 aa, Secale cereale
MSKLSTEALKEAITQVVADAKEKNRKFTETVELQIGLKNYDPQKDKRFSGSVKLPHVPRPKMRVCMLGDAQHVGEADKIGLDSMDVEALKKMNKNKKLVKRLAKKYHAFLASEAIIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 25892 - protein, 216 aa, Thalictrum flavum
MSKLQSDVLREAITQVTGEAKEKKRKFTETVELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNESKAMVKFQLKKVLCMGVAVGNLGMDEKQIFQNVQLSVNFLVSLLKKNWQNVRCLYLKSSMGKPFRIF

SEQ ID NO: 25893 - protein, 216 aa, Cannabis sativa
MSKLSSDAVREGIAQIVINSKEKNRKFTETIELQIGLKNYDPQKDKRFSGSVKLPHIPRPKMKICMLGDAQHVEEAVKIGLDYMDVEGLKKLNKNKKLVKKLAKKFHAFLASEAVIKQIPRLLGPGLNKAGKFPTLVTHQESLEAKVNETKAMVKFQLKKVLCMGVAVGNLSMEEKQIFQNVQMSVNFLVSLLKKNWQNVRCLYLKSTMGSAIRIF

SEQ ID NO: 25894 - protein, 216 aa, Ambrosia trifida
MSKLQSEALREAITQITTAANEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPIRIF

SEQ ID NO: 25895 - protein, 216 aa, Ambrosia trifida
MSKLQSEALREAITQITTAATEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPIRIF

SEQ ID NO: 25896 - protein, 217 aa, Brassica napus
  Sequence also found in Organisms: Brassica juncea, Brassica oleracea, Brassica rapa
MSKLQSEAVREAISSMITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLEAKVNETKATVKFQLKKVLCMGVAVGNLDMEEKQIFQNVQMSVNFLVSLLKKNWQNVRCLYLKSTMGPPNRVF

SEQ ID NO: 25897 - protein, 217 aa, Arabidopsis thaliana
  Sequence also found in Organisms: Arabidopsis lyrata
MSKLQSEAVREAISSIITHCKETKPRNFTETIELQIGLKNYDPQKDKRFSGSVKLPHVPRPKMKICMLGDAQHVEEAEKIGLESMDVEALKKLNKNKKLVKKLAKKFHAFLASESVIKQIPRLLGPGLNKAGKFPTLVSHQESLESKVNETKATVKFQLKKVLCMGVAVGNLSMEEKQIFQNVQMSVNFLVSLLKKNWQNVRCLYLKSTMGPPNRVF

SEQ ID NO: 25898 - protein, 217 aa, Raphanus sativus
MSKLQSEAVREAISAMITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLEAKVNETKATVKFQLKKVLCMGVAVGNLDMEEKQIFQNVQMSVNFLVSLLKKNWQNVRCLYLKSTMGPPNRVF

SEQ ID NO: 25899 - protein, 217 aa, Brassica napus
  Sequence also found in Organisms: Brassica rapa
MSKLQSEAVKEAISTIITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLEAKVNETKATVKFQLKKVLCMGVAVGNLGMEEKQIFQNVQMSVNFLVSLLKKNWQNVRCLYLKSTMSPPTRVF

SEQ ID NO: 25900 - protein, 216 aa, Malus domestica
MSKLSSDGLREAISQIKTNSETKKRKFTETVELQIGLKNYDPQKDKRFSGSVRLPHIPRPKMRVCMLGDAQHVEEAEKMGLDYMDVESLKKLNKNKKLVKKLAKKYHAFLASEAVIKQIPRLLGPGLNKAGKFPTLVSHQESLEAKLNETKAMVKFQLKKVLCMGVAVGNLAMEEKQIFQNVQLSVNFLVSLLKKNWQNVRSLNLKSTMGKAIRIY

SEQ ID NO: 25901 - protein, 216 aa, Centaurea maculosa
  Sequence also found in Organisms: Cirsium arvense
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEEKQIFQNVQMSVNFLVSLLKKNWQNVRCLYLKTTMGKPVRIF

SEQ ID NO: 25902 - protein, 216 aa, Avena sativa
MSKLSTEALKEAITQVVTEAKEKNRKFTETIELQIGLKNYDPQKDKRFSGSVKLPHVPRPKMRVCMLGDAQHVGEAEKIGLDSMDVEALKKMNKNKKLVKRLAKKYHAFLASEAIIKQIPRLLGPGLNKAGKFPTLVSHSESLEAKVNETKATIKFQLKKVLCMGVAVGNLSMEEKQIQQNIQMSVNFLVSLLKKNWQNVRCLYIKSTMGKPARVF

SEQ ID NO: 25903 - protein, 216 aa, Prunus persica
  Sequence also found in Organisms: Prunus mume
MSKLSSDGLREAIAQIKTNSETKKRNFTETVELQIGLKNYDPQKDKRFSGSVRLPHIPRPKMRVCMLGDAQHVEEAEKMGLDYMDVESLKKLNKNKKLVKKLAKKYHAFLASEAVIKQIPRLLGPGLNKAGKFPTLVSHQESLEAKVNETKAMVKFQLKKVLCMGVAVGNLAMEEKQIFQNVQLSVNFLVSLLKKNWQNVRSLNLKSTMGKAIRIY

SEQ ID NO: 25904 - protein, 216 aa, Leymus cinereus x Leymus triticoides
MSKLQTEALKEAITQVVAEAKEKNRKFTETVELQIGLKNYDPQKDKRFSGSVKLPHVPRPKMRVCMLGDAQHVGEADKIGLDSMDVEALKKMNKNKKLVKRLAKKYHAFLASEAVIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 25905 - protein, 216 aa, Aristolochia fimbriata
MSKLQSDVLREAIGQVMADAKERKRNFTETIELQIGLKNYDPQKDKRFSGSVKLPHIPRPKMKVCMLGDAQHVEEAEKIGMDYMDVEGLKKLNKNKKLVKKLAKKYHAFLASEAIIKQIPRLLGPGLNKAGKFPTLVTHQESLESKVNETKAMVKFQLKKVLCMGVAVGNCGMEEKQVFQNIQLSVNFLVSLLKKNWQNVRCLYIKRTMGKPYRVF

SEQ ID NO: 25906 - protein, 216 aa, Brassica napus
  Sequence also found in Organisms: Brassica rapa
MSKLQSEVLREGITAVKGKADEKKRNFVETVELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSVNFLVSLLKKNWQNVRCLYLKSTMGPPQRIF

SEQ ID NO: 25907 - protein, 216 aa, Salvia sclarea
MSKLQSEALREAITVIVAEANEKKRNFTQTVELQIGLKNYDPQKDKRFSGSVRLPHIPRPKMKLCMLGDAQHVEEAEKIGLESMDVEALKKLNKNKKLVKKLAKRYHAFLASEAVIKQIPRLLGPGLNKAGKFPTLVTHQESLEAKVNETKATVKFQLKKVLCMGVAVGNLDMEEKQIFQNVQMSVNFLVSLLKKNWQNVRCLYLKSTMGRVQRIF

SEQ ID NO: 25908 - protein, 216 aa, Fragaria vesca
MSKLQSDTLREAISVIMAASKEKNRKFTETIELQIGLKNYDPQKDKRFSGSVKLPHIPRPKMKVCMLGDAQHVEEAQKIGLEYMDVEALKKLNKNKKLVKKLAKKYHAFLASEAVIKQIPRLLGPGLNKAGKFPTLVSHQESLESKISETKATIKFQLKKVLCMGVAVGNVSMEEKQIFQNVQLSVNFLVSLLKKNWQNVKCLNLKTTMGKPYRVY

SEQ ID NO: 25909 - protein, 216 aa, Tragopogon dubius
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEGKVNETKATVKFQLKKVLCMGVAVGNCSMEEKQIFQNVQMSVNFLVSLLKKNWQNVRCLYLKTTMGKPVRIF

SEQ ID NO: 25910 - protein, 211 aa, Lotus japonicus
MSKLQNDAVREAISGIMTDSKEKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGKFPTLVTHQESLESKVNETKAMVKFQLKKVLCMGVAVGNVSMEEKQIFQNVQLSVNFLVSLLKKNWQNVRCLYLKSTMGKSYRVF

SEQ ID NO: 25911 - protein, 216 aa, Fragaria vesca
MSKLQSEALREAISQIKTNAETKKRKFTETVELQIGLKNYDPQKDKRFSGSVRLPHIPRPKMRVCMLGDAQHVEEAEKMGLAYMDVESLKKLNKNKKLVKKLAKKYHAFLASEAVIKQIPRLLGPGLNKAGKFPTLVSHQESLEAKLNETKAMVKFQLKKVLCMGVAVGNLAMEEKQIFQNVQLSVNFLVSLLKKNWQNVRSLNLKSTMGKAIRIY

SEQ ID NO: 25912 - protein, 216 aa, Mesembryanthemum crystallinum
MSKLQSDAVREAISGIQNDAREKNRKFTETIELQIGLKNYDPQKDKRFSGTVKLPNIPRPKMKVCMLGDAQHVEEAERIGLEWMDVEALKKLNKNKKLVKKLAKKYHAFLASESVIKQIPRLLGPGLNKAGKFPALVTHQEPLENKVNEAKATVKFQLKKVLCMGVAVGNCGMDDKQIFQNVQMSVNFLVSLLKKNWQNVRCLYLKSTMGQPYRIF

SEQ ID NO: 25913 - protein, 216 aa, Pisum sativum
MSKLQSEAVREAISGIMGDSKDKQRKFVETIELQIGLKNYDPQKDKRFSGSVKLPHIPRPKMKICMLGDAQHVEEAEKIGLESMDVEALKKLNKNKKLVKKLAKRYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 25914 - protein, 216 aa, Triphysaria pusilla
MSKVSPDAIREAIATIATESKEKNRKFTETIELQIGLKNYDPQKDKRFSGSVKLPHIPRPKMQICMLGDAQHADEAEKIGLASMDVEALKKLNKNKKLVKKLAKKYHAFLASEAVIKQIPRLLGPGLNKAGKFPTLVSHQESLEGKVNETKATIKFQLKKVLCMGVAVGNLGMEEKQIFQNVQMSINFLVSLLKKNWQNVRCLYLKSTMGKPQRIF

SEQ ID NO: 25915 - protein, 216 aa, Papaver somniferum
MSKLQSEVLREAISQINTEATAKKRKFTETVELQIGLKNYDPQKDKRFSGSVKLPHIPRPKMKVCMLGDAQHVEEAQKIGLEYMDVEGLKKLNKNKKLVKKLAKKFHAFLASEAVIKQIPRLLGPGLNKAGKFPTLVTHQESLEAKVNETKAMVKFQLKKVLCMGVAVGNLGMEEKQIFQNVQLSVNFLVSLLKKNWQNVRCLYLKSTMGKPVRIF

SEQ ID NO: 25916 - protein, 216 aa, Arnica chamissonis
MSKLQSEALREAITQITTDAKEKKRNFTETVELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 25917 - protein, 216 aa, Ambrosia trifida
MSKLQSEALREAITQITTNATEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPIRIF

SEQ ID NO: 25918 - protein, 216 aa, Ambrosia trifida
MSKLQSEALREAITQITTAAKENKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPIRIF

SEQ ID NO: 25919 - protein, 216 aa, Epimedium sagittatum
MSKLQSDVLRECITKIVERSNTKKRKFTETIELQIGLKNYDPQKDKRFSGSVKLPHIPRPKMKVCMLGDAQHVEEAVKIGLEFMDVEGLKKLNKNKKLVKKLAKKYHAFLASEAVIKQIPRLLGPGLNKAGKFPTLVTHQEALESKVNETKAMVKFQLKKVLCMGVAVGNLGMDEKQIFQNVQLSVNFLVSLLKKNWQNVRCLYLKSSMGRPERIF

SEQ ID NO: 25920 - protein, 216 aa, Helianthus annuus
MSKLQSEALREAITQITTDAKEKKRNFTETIELQIGLKNYDPQKDKRFSGTVKLPHIPRPKLKACMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 25921 - protein, 216 aa, Rosa hybrid cultivar
MSKLQSEALREAISQIKTNSETKKRKFTETVELQIGLKNYDPQKDKRFSGSVKLPHIPRPKMRVCMLGDAQHVEEAEKMGLAYMDVESLKKLNKNKKLVKKLAKKYHAFLASEAVIKQIPRLLGPGLNKAGKFPTLVSHQESLEAKLNETKAMVKFQLKKVLCMGVAVGNLAMDEKQIFQNVQLSVNFLVSLLKKNWQNVRSLNLKSTMGKAIRIY

SEQ ID NO: 25922 - protein, 220 aa, Amsonia hubrichtii
MSKLQSDAVKEAIAQIVTDSKGDNGEKKRKFTETVELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNLDMEEKQIFQNVQMSVNFLVSLLKKNWQNVRCLYLKSTMGRPQRIF

SEQ ID NO: 25923 - protein, 217 aa, Artemisia annua
  Sequence also found in Organisms: Chrysanthemum coronarium
MSKLSSEALREAITSITTDAKEKKVRNFTETIELQIGLKNYDPQKDKRFSGTVRLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 25924 - protein, 216 aa, Centaurea maculosa
  Sequence also found in Organisms: Cirsium arvense, Cynara scolymus, Gerbera hybrid cultivar, Carthamus tinctorius
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEDKQIFQNVQMSVNFLVSLLKKNWQNVRCLYLKTTMGKPVRIF

SEQ ID NO: 25925 - protein, 215 aa, Zea mays
MSKLHSELLKDCISQIVQDAKKNRKFTETVELQISLKNYDPQKDKRFSGSVKLPHIPRPKMKVCMLGDAQHVEEAEKMGLDYMDVEALKKMNKNKKLVKKLAKKYHAFLASETIIKQIPRLLGPGLNKAGKFPTLVTHQESLESKVNETKATVKFQLKKVLCMGVAVGNLSMEEKQIQQNIQMSINFLVSLLKKNWQNVRCLYIKSTMGKPFRIF

SEQ ID NO: 25926 - protein, 216 aa, Raphanus sativus
MSKLQSEVLREGIAAVKGKADEKKRNFVETVELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSVNFLVSLLKKNWQNVRCLYLKSTMGPPQRIF

SEQ ID NO: 25927 - protein, 216 aa, Marchantia polymorpha
MSKLQSDVLREAITQVVTEAKEKNRKFTETVELQIGLKNYDPQKDKRFSGSVKLPHVPRPKMKVCMLGDAQHVEEAEKMGLDYMDIESLKKMNKNKKLVKKLAKKYHAFLASEAVIKQIPRLLGPGLNKAGKFPALVSHQESLEAKVNETKAMVKFQLKKVLCMGVAVGNCEMEEKQIFQNTQLSVNFLVSLLKKNWQNVRVLYLKTSMGKPVRIY

SEQ ID NO: 25928 - protein, 216 aa, Cirsium arvense
  Sequence also found in Organisms: Cynara scolymus
MSKLGSEAVREAITQITTEAKEKNRKFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLESKVNEIKATVKFQLKKVLCMGVAVGNCSMEEKQIFQNVQMSVNFLVSLLKKNWQNVRCLYLKTTMGKPVRVF

SEQ ID NO: 25929 - protein, 216 aa, Centaurea maculosa
  Sequence also found in Organisms: Carthamus tinctorius
MSKLQSEALREAITQITTDAKEKKRNFTETIELQIGLKNYDPQKDKRFSGTVKLPHIPRPKLKVCMLGDAQHVEEAQKIGLEYMDVEALKKLNKNKKLVKKLAKKHQAFLASESVIKQIPRLLGPGLNKAGKFPTLVTHQESLEAKVNETKATVKFQLKKVLCMGVAVGNCSMEDKQIFQNVQMSVNFLVSLLKKNWQNVRCLYLKTTMGKPVRIF

SEQ ID NO: 25930 - protein, 216 aa, Tragopogon dubius
MSKLQSEALREAITQITTDAKEKKRNFTETIELQIGLKNYDPQKDKRFSGTVKLPHIPRPKLKVCMLGDAQHVEEAQKIGLEYMDVEALKKLNKNKKMVKKLAKKHQAFLASESVIKQIPRLLGPGLNKAGKFPTLVTHQESLEGKVNETKATVKFQLKKVLCMGVAVGNCSMEEKQIFQNVQMSVNFLVSLLKKNWQNVRCLYLKTTMGKPVRIF

SEQ ID NO: 25931 - protein, 216 aa, Parthenium argentatum
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQDSLEAKVNETKATVKFQLKKVLCMGVAVGNCSMEEKQIFQNVQMSVNFLVSLLKKNWQNVRCLYLKTTMGKPVRIF

SEQ ID NO: 25932 - protein, 216 aa, Rosa hybrid cultivar
MSKLQSDTLREAISIIMAASKEKSRKFTETIELQIGLKNYDPQKDKRFSGSVKLPHIPRPKMKVCMLGDAQHVEEAQKIGLEYMDVEALKKLNKNKKLVKKLAKKYHAFLASEAVIKQIPRLLGPGLNKAGKFPTLVSHQESLESKISETKATIKFQLKKVLCMGVAVGNVSMEEKQIFQNVQLSVNFLVSLLKKNWQNVKCLNLKTTMGKPYRIY

SEQ ID NO: 25933 - protein, 216 aa, Ocimum basilicum
MSKLQSEALREAISVIKNDSAEKKRKFSETIELQIGLKNYDPQKDKRFSGSVRLPHIPRPKMKICMLGDAQHVGEAEKIGLEYMDVESLKKLNKNKKLVKKLAKKYHAFLASESVIKQIPRLLGPGLNKAGKFPTLVSHQESLESKVNETKATIKFQMKKVLCMGVAVGNCDMEEKQIFQNVQMSVNFLISLPKKNWQNVRCLFLKSPMGKTQRVF

SEQ ID NO: 25934 - protein, 216 aa, Papaver somniferum
MSKLQSEVLREAISQIGTEAKDKKRKFTETVELQIGLKNYDPQKDKRFSGSVKLPHIPRPKMKVCMLGDAQHVEEAQKIGLEYMDVEGLKKLNKNKKLVKKLAKKFHAFLASEAVIKQIPRLLGPGLNKAGKFPTLVTHQESLEAKVNETKAMVKFQLKKVLCMGVAVGNLGMEDKQIFQNVQLSVNFLVSLLKKNWQNVRCLYLKSTMGKPVRIF

SEQ ID NO: 25935 - protein, 216 aa, Papaver somniferum
MSKLQSEVLREAISQINTEATTKKRNFTETVELQIGLKNYDPQKDKRFSGSVKLPHIPRPKMKVCMLGDAQHVEEAQKIGLEYMDVEGLKKLNKNKKLVKKLAKKFHAFLASEAVIKQIPRLLGPGLNKAGKFPTLVTHQESLEAKVNETKAMVKFQLKKVLCMGVAVGNLGMEEKQIFQNVQLSVNFLVSLLKKNWQNVRCLYLKSTMGKPVRIF

SEQ ID NO: 25936 - protein, 216 aa, Papaver somniferum
MSKLQSEVLREAISQIGTEAKDKKRNFTETMELQIGLKNYDPQKDKRFSGSVKLPHIPRPKMKVCMLGDAQHVEEAQKIGLDYMDVEGLKKLNKNKKLVKKLAKKFHAFLASEAVIKQIPRLLGPGLNKAGKFPTLVTHQESLEAKVNETKAMVKFQLKKVLCMGVAVGNLGMEDKQIFQNVQLSVNFLVSLLKKNWQNVRCLYLKSTMGKPVRIF

SEQ ID NO: 25937 - protein, 216 aa, Papaver somniferum
MSKLAADVVKEAIAQIVAESKEKNRNFTETIELQIGLKNYDPQKDKRFSGSVRLPHIPRPKMKVCMLGDAQHVEEAQSIGLDHMDVEGLKRLNKNKKLVKKLAKKYHAFLASEAVIKQIPRLLGPGLNKAGKFPTLVTHQESLESKVNETKAMVKFQLKKVLCMGVAVGNLGMEERQIFQNVQLSVNFLVSLLKKNWQNVRCLYLKSTMGKVNRVF

SEQ ID NO: 25938 - protein, 216 aa, Epimedium sagittatum
MSKLQSDVLRECITKVVERSSTKKRKFTETIELQIGLKNYDPQKDKRFSGSVKLPHIPRPKMKVCMLGDAQHVEEAVKIGLEYMDVEGLKKLNKNKKLVKKLAKKYHAFLASEAVIKQIPRLLGPGLNKAGKFPTLVTHQEALESKVNETKAMVKFQLKKVLCMGVAVGNLGMDEKQIFQNVQLSVNFLVSLLKKNWQNVRCLYLKSSMGRPERIF

SEQ ID NO: 25939 - protein, 216 aa, Fagopyrum esculentum
MSKLSNDALREAISTISKSAAEKPKKFTETIELQIGLKNYDPQKDKRFSGSVKLPHVPRPKMKVCMLGDAQHVEESEKVGLDSMDVEALKKLNKNKKLVKKLAKKYHAFLASEAVIKQIPRLLGPGLNKAGKFPTLVSHQESLENKVQEIKSTVKFQLKKVLCMGVAVGNCGMEEKQIFQNVQMSVNFLVSLLKKNWQNVRCLYLKSTMGRPVRIF

SEQ ID NO: 25940 - protein, 212 aa, Flaveria ramosissima
MSKLQSDALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEEKQIFQNVQMSVNFLVSLLKKNWQNVRCLYLKTTMGKP

SEQ ID NO: 25941 - protein, 216 aa, Helianthus annuus
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLGSLVKKNWQNVRCLYLKTTMGKPVRIF

SEQ ID NO: 25942 - protein, 216 aa, Linum usitatissimum
MSKLQSDSLREAITTIKTAAQEKPRKFTETVELQIGLKNYDPQKDKRFSGSVKLPHIPRPKMKVCMLGDAQHVEEANAMGLQSMDVESLKKLNKNKKLVKKLAKQYHAFLASESVIKQIPRLLGPGLNKAGKFPTLVSHQESLESKVNEIKATVKFQLKKVLCMGVAVGNLDMDEKQIFQNVQMSINFLVSLLKKNWQNVKVLNLKSTMGKPVQIF

SEQ ID NO: 25943 - protein, 205 aa, Sequoia sempervirens
AITGLVGESKEKNRKFVETIELQIGLKNYDPQKDKRFSGSVKLPHIPRPKMKLCMLGDAQHVEEAVKIGLDYMDVEGLKKMNKNKKLVKKLAKKYHAFLASEAIIKQIPRLLGPGLNKAGKFPTLVSHQESLEGKVNETKATIKFQLKKVLCMGVAVGNCGMEEKQIFQNVQLSVNFLVSLLKKNWQNVRCLYLKSTMGKPSRIF

SEQ ID NO: 25944 - protein, 216 aa, Physcomitrella patens
MSKLQSDVLREAITQITTAAKEKNRKFTETVELQIGLKNYDPQKDKRFSGSVKLPHIPRPKMRVCMLGDAQHVEEANKIGMEYMDVESLKKMNKNKKLVKKLAKKYHAFLASESVIKQIPRLLGPGLNKAGKFPTLVSHQESLESKGQELKAMVKFQLKKVLCMGVAIGNCDMEEKQIFQNTQMGVNFLVSLLKKNWQNVRVLYLKTTMGTPVRIY

SEQ ID NO: 25945 - protein, 216 aa, Physcomitrella patens
MSKLQSDVLREAITQITTAAKEKNRKFTETVELQIGLKNYDPQKDKRFSGSVKLPHIPRPKMRVCMLGDAQHVEEANKMGMEYMDVESLKKMNKNKKLVKKLAKKYHAFLASESVIKQIPRLLGPGLNKAGKFPTLVSHQESLDAKCQETKAMVKFQLKKVLCMGVAIGNCDMEEKQIFQNTQMGVNFLVSLLKKNWQNVRVLYLKTTMGTPVRIY

SEQ ID NO: 25946 - protein, 216 aa, Linum usitatissimum
MSKLQSDSLRDAITTIKTAAQEKPRKFTETVELQIGLKNYDPQKDKRFSGSVKLPHIPRPKMKVCMLGDAQHVEEANAMGLQSMDVESLKKLNKNKKLVKKLAKQYHAFLASESVIKQIPRLLGPGLNKAGKFPTLVSHQESLESKVNEIKATVKFQLKKVLCMGVAVGNLDMDEKQIFQNVQMSINFLVSLLKKNWQNVKVLNLKSTMGKPVQIF

SEQ ID NO: 25947 - protein, 216 aa, Zostera marina
MSKLQSDVLREAIGQITAACSDKKRNFTETIELQIGLKNYDPQKDKRFSGSVKLPHIPRPKMKVCMLGDAQHVEEASKISLSSMSVEDLKKFNKNKKLVKKMSKKYHAFLASEAVIKQIPRLLGPGLNKAGKFPTLVSHQESLEAKVNEIKATVKFQLKKVLCMGVAVGNVGMDEKQIFQNVQLSVNFLVSLLKKNWQNVKCLHLKSTMGKPFRLF

SEQ ID NO: 25948 - protein, 216 aa, Papaver somniferum
MSKLQSEVLREAISQINTEATAKKRNFTETVELQIGLKNYDPQKDKRFSGSVKLPHIPRPKMKVCMLGDAQHVEEAQKIGLEYMDVEGLKKLNKNKKMVKKLAKKFHAFLASEAVIKQIPRLLGPGLNKAGKFPTLVTHQESLEAKVNETKAMVKFQLKKVLCMGVAVGNLGMEEKQIFQNVQLSVNFLVSLLKKNWQNVRCLYLKSTMGKPVRIF

SEQ ID NO: 25949 - protein, 206 aa, Cephalotaxus harringtonia
EAITTVVGDSKEKPKKFVETIELQIGLKNYDPQKDKRFSGSVKLPHIPRPKMKLCMLGDAQHVEEAVKIGLDYMDVEGLKKMNKNKKLVKKLAKKYHAFLASEAIIKQIPRLLGPGLNKAGKFPTLVSHQESLEGKVNETKATIKFQLKKVLCMGVAVGNCGMEEKQIFQNVQLSVNFLVSLLKKNWQNVRCLYLKSTMGKPSRIF

SEQ ID NO: 25950 - protein, 213 aa, Flaveria ramosissima
LQSDALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEEKQIFQNVQMSVNFLVSLLKKNWQNVRCLYLKTTMGKPVRIF

SEQ ID NO: 25951 - protein, 216 aa, Helianthus annuus
MSKLQSEALREAITQITTDAKEKKRNFTETIELQIGLKNYDPQKDKRFSGTVKLPHIPRPKLKVCMLGDAQHGEEAQKIGLEYMDIEGLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIL

SEQ ID NO: 25952 - protein, 216 aa, Linum usitatissimum
MSKLQSESLREAISTIKTAAQEKPRKFTETIELQIGLKNYDPQKDKRFSGSVKLPHIPRPKMKVCMLGDAQHVEEANAMGLQSMDVESLKKLNKNKKLVKKLAKQYHAFLASESVIKQIPRLLGPGLNKAGKFPTLVSHQESLESKVNEIKATVKFQLKKVLCMGVAVGNLDMDEKQIFQNVQMSINFLVSLLKKNWQNVKVLNLKSTMGKPVQIF

SEQ ID NO: 25953 - protein, 221 aa, Cannabis sativa
CNCYDNSKLQSEVLREAIATIMNESREKNRNFTETIELQIGLKNYDPQKDKRFSGSVKLPHIPRPKMKVCMLGDAQHVEEAVKINLDYMDVEGLKKLNKNKKLVKKLAKKYHAFLASEAVIKQIPRLLGPGLNKAGKFPTLVTHQESLESKVNETKAMVKFQLKKVLCMGVAVGNLSMEEKQVFQNVQMSVNFLVSLLKKNWQNVRCLFLKTTMGKPQRVF

SEQ ID NO: 25954 - protein, 216 aa, Ricinus communis
MSKLQSEALREAITTIMAASKEKKRKFTETIELQIGLKNYDPQKDKRFSGSVKLPHIPRPKMKICMLGDAQHVEEAEAIGLQWMDVEALKKLNKNKKLVKKLAKQYHAFLASESVIKQIPRLLGPGLNKAGKFPTLVTHQESLESKVNETKATVKFQLKKVLCMGVAVGNCSMEEKQVFQNVQMSVNFLVSLLKKNWQNVKCLNLKTTMGTPQRIF

SEQ ID NO: 25955 - protein, 216 aa, Ricinus communis
MSKLQSEALREAITTIMTASKEKKRKFTETIELQIGLKNYDPQKDKRFSGSVKLPHIPRPKMKICMLGDAQHVEEAEAIGLQWMDVEALKKLNKNKKLVKKLAKQYHAFLASESVIKQIPRLLGPGLNKAGKFPTLVNHQESLESKVNETKATVKFQLKKVLCMGVAVGNCSMEEKQVFQNVQMSVNFLVSLLKKNWQNVKCLNLKTTMGSPQRVF

SEQ ID NO: 25956 - protein, 208 aa, Leymus cinereus x Leymus triticoides
VKDAITQIVGEAREKKRKFTETVELQIGLKNYDPQKDKRFSGSVKLPHIPRPKMRVCMLGDAQHVDQAEKMGLDYMDVESLKKMNKNKKLVKKLAKKYHAFLASEAIIKQIPRLLGPGLNKAGKFPTLVSHQESLEAKVNETKATVKFQLKKVLCMGVAVGNLSMDEKQIQQNIQMSVNFLVSLLKKNWQNVRCLYVKSTMGKRVRVF

SEQ ID NO: 25957 - protein, 216 aa, Castanea mollissima
  Sequence also found in Organisms: Quercus alba
MSKLQSDTLREVISQVVNNAKEKKRNFTETIELQIGLKNYDPQKDKRFSGSVKLPHIPRPKMKICMLGDAQHVEEAEKVGLEYMDVEGLKKLNKNKKLVKKLAKKYHAFLASESVIKLIPRLLGPGLNKAGKFPTLVTHQESLESKVNETKAMVKFQLKKVLCMGVAVGNCSMEEKQIFQNVQMSVNFLVSLLKKNWQNVRCLNLKSTMGSAVRLY

SEQ ID NO: 25958 - protein, 204 aa, Actinidia deliciosa
MSKLQSEALREAISQISNDAKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNCSMEEKQIFQNVQMSVNFLVSLLKKNWQNVRCLY

SEQ ID NO: 25959 - protein, 216 aa, Euphorbia peplus
  Sequence also found in Organisms: Euphorbia esula
MSKLQSEALREAITTIMTASKEKKRNFTETIELQIGLKNYDPQKDKRFSGSVKLPHIPRPKMKVCMLGDAQHVEEATAIGLQWMDVEALKKLNKNKKLVKKLAKQYHAFLASESVIKQIPRLLGPGLNKAGKFPTLVTHQESLESKVNETKATVKFQLKKVLCMGVAVGNCAMEEKQVFQNVQMSVNFLVSLLKKNWQNVKCLNLKTTMGSPQRVF

SEQ ID NO: 25960 - protein, 216 aa, Physcomitrella patens
MSKLQSDVLREAITQIVAAAKEKNRKFTETVELQIGLKNYDPQKDKRFSGSVKLPHIPRPKMRICMLGDAQHIEEATKNGIECMDVESLKKMNKNKKLVKKLAKKYHAFLASESVIKQIPRLLGPGLNKAGKFPALVSHQESLESKVLESKAMVKFQLKKVLCMGVAIGNCGMEEKQIFQNTQMGVNFLVSLLKKNWQNVRVLYLKTTMGAPVRIY

SEQ ID NO: 25961 - protein, 216 aa, Fagus grandifolia
MSKLQSDTLREVISQVVNNAKEKKRNFTETIELQIGLKNYDPQKDKRFSGSVKLPHIPRPKMKLCMLGDAQHVEEAEKVGLEYMDVEGLKKLNKNKKLVKKLAKKYHAFLASESVIKLIPRLLGPGLNKAGKFPTLVTHQESLESKVNETKAMVKFQLKKVLCMGVAVGNCGMEEKQIFQNVQMSINFLVSLLKKNWQNVRCLNLKSTMGSAVRLY

SEQ ID NO: 25962 - protein, 216 aa, Malus domestica
MSKLQSDTLREGISIIMTASKEKKRNFTETIELQIGLKNYDPQKDKRFSGSVRLPHIPRPKMKVCMLGDAQHVEEAEKIGLDYMDVEGLKKLNKNKKLVKKLAKKYHAFLASEAVIKQIPRLLGPGLNKAGKFPTLVSHQESLESKVSETKAMIKFQLKKVLCMGVAVGNVSMEEKQVFQNVQLSVNFLVSLLKKNWQNVRCLHLKTTMGKPYRIY

SEQ ID NO: 25963 - protein, 216 aa, Linum usitatissimum
MSKLQSETLREAISAIKAAANEKPRKFTETVELQIGLKNYDPQKDKRFSGSVKLPHIPRPKMKVCMLGDAQHVEEANAMGLQSMDVESLKKLNKNKKLVKKLAKSYHAFLASESVIKQIPRLLGPGLNKAGKFPTLVSHQESLESKVNEIKATVKFQLKKVLCMGVAVGNLDMDEKQIFQNVQMSINFLVSLLKKNWQNVKVLNLKSTMGKPQSIF

SEQ ID NO: 25964 - protein, 200 aa, Pinus taeda
MGDTKEKQRKFTETIELQIGLKNYDPQKDKRFSGSVKLPHIPRPKMKVCMLGDAQHVEEAEKLGLDYMDVEGLKKMNKNKKLVKKLAKKYHAFLASEAIIKQIPRLLGPGLNKAGKFPTLVSHQESLEGKVNETKATVKFQLKKVLCMGVAVGNCGMEEKQIFQNVQLSVNFLVSLLKKNWQNVRCLYLKSTMGKPNRVF

SEQ ID NO: 25965 - protein, 190 aa, Avena sativa
FSETIELQIGLKNYDPQKDKRFSGSVKLPHIPRPKMRVCMLGDAQHVEEAGKMNLDYMDVESLKKMNKNKKLVKKLAKKYHAFLASEAIIKQIPRLLGPGLNKAGKFPTLVSHQESLEAKVNETKATVKFQLKKVLCMGVAVGHMGMDEKQIFQNVQMSVNFLVSLLKKNWQNVRCLYLKSTMGKPHRLF

SEQ ID NO: 25966 - protein, 204 aa, Camellia sinensis
MSKLQSDALREAITQITNDAKEKKRNFTETVELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNLSMEEKQIFQNVQMSVNFLVSLLKKNWQNVSACT

SEQ ID NO: 25967 - protein, 216 aa, Ceratodon purpureus
MSKLQSDVLREAISQITTAAKEKNRKFTETVELQIGLKNYDPQKDKRFSGSVKLPHIPRPKMKVCMLGDAQHVEEANKIGMECMDVESLKKMNKNKKLVKKMAKKYHAFLASESVIKQIPRLLGPGLNKAGKFPALVSHQESLEAKMMETKAMVKFQLKKVLCMGVAIGNCEMEEKQIFQNTQMSVNFLVSLLKKNWQNVRVLYLKTTMGAPVRIY

SEQ ID NO: 25968 - protein, 206 aa, Parthenium argentatum
MSKLQSEALREAITQITTDAKEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLK

SEQ ID NO: 25969 - protein, 216 aa, Silene vulgaris
MSKLSSEAVREAIAGISSDAKEKGRKFTETIELQIGLKNYDPQKDKRFSGSVKLPHVPRPKMKVCMLGDAQHVEEAERIGMESMDVEALKKLNKNKKLVKKLAKKYHSFLASESVIKQIPRLLGPGLNKAGKFPTLVSHQEPLENKVNETKATIKFQLKKVLCMGVAVGNCSMDEKQIFQNVQMSVNFLVSLLKKNWQNVRCLYLKSTMGRPYRIF

SEQ ID NO: 25970 - protein, 216 aa, Linum usitatissimum
MSKLQSESLREAISTIKTAAQVKPRKFTETVELQIGLKNYDPQKDKRFSGSVKLPHIPRPKMKVCMLGDAQHVEEANAMGLQSMDVESLKKLNKNKKLVKKLAKQYHAFLASESVIKQIPRLLGPGLNKAGKFPTLVSHQESLESKVNEIKATVKFQLKKVLCMGVAVGNLDMDEKQIFQNVQMSINFLVSLLKKNWQNVKVLNLKSTMGKPVQIF

SEQ ID NO: 25971 - protein, 216 aa, Silene vulgaris
MSKLSSDAVREAISGILTDAKDKERKFVQTIELQIGLKNYDPQKDKRFSGSVKLPHVPRPKMKVCMLGDAQHVEEAERVGLESMDVEALKKLNKNKKLVKKLAKKYHSFLASESVIKQIPRLLGPGLNKAGKFPTLVTHQEPLENKVNEIKATIKFQLKKVLCMGVAVGNCGMDEKQIFQNVQMSVNFLVSLLKKNWQNVRCLYLKSTMGRPYRIF

SEQ ID NO: 25972 - protein, 216 aa, Manihot esculenta
MSKLQSEALREAISTIMTASKEKKRNFTETIELQIGLKNYDPQKDKRFSGSVKLPHIPRPKMKICMLGDAQHVEEAEGIGLQWMDVEALKKLNKNKKLVKKLAKQYHAFLASESVIKQIPRLLGPGLNKAGKFPTLVTHQESLESKVNETKATVKFQLKKVLCMGVAVGNCAMEEKQVFQNVQMSVNFLVSLLKKNWQNVKCLHLKTTMGAPQRVF

SEQ ID NO: 25973 - protein, 216 aa, Hevea brasiliensis
MSKLQSEALREAISTIMTASKEKKRNFTETIELQIGLKNYDPQKDKRFSGSVKLPHIPRPKMKICMLGDAQHVEEAEGIGLQWMDVEALKKLNKNKKLVKKLAKQYHAFLASESVIKQIPRLLGPGLNKAGKFPTLVTHQESLESKVNETKATVKFQLKKVLCMGVAVGNCAMEEKQVFQNVQMSVNFLVSLLKKNWQNVKCLHLKTTMGAPQRIF

SEQ ID NO: 25974 - protein, 216 aa, Carpinus betulus
MSKLSSDTLKESISTIMAGSKDKKRNFTETIELQIGLKNYDPQKDKRFSGSVKLPHIPRPKMKVCMLGDAQHVEEAEKIGLDYMDVEALKKLNKNKKLVKKLAKKYHAFLASEAVIKQIPRLLGPGLNKAGKFPTLVTHQESIESKVNETKAMVKFQLKKVLCMGVAVGNGAMEEKQIFQNVQMSVNFLVSLLKKNWQNVRSLSLKTTMGKPVRVY

SEQ ID NO: 25975 - protein, 210 aa, Sarracenia psittacina
MQSGRLSPKLLEMQKKKRRNFVETIELQIGLKNYDPQKDKRFSGSVKLPHIPRPKMKVCMLGDAQHVEEAEKIGLDYMDVEGLKKLNKNKKLVKKLAKKYHAFLASEAVIKQIPRLLGPGLNKAGKFPTLVSHQESLESKVNETKATVKFQLKKVLCMGVAVGNCGMEDKQIFQNVQMSVNFLVSLLKKNWQNVRCLYLKSTMGRPVRIF

SEQ ID NO: 25976 - protein, 216 aa, Quercus alba
MSKLQSDTLREAISTLFAGSRDKKRNFTETIELQIGLKNYDPQKDKRFSGSVKLPHIPRPKMKVCMLGDAQHVEEAEKMGLDYMDVEALKKLNKNKKLVKKLAKKYHAFLASESVIKLIPRLLGPGLNKAGKFPTLVTHQESIDSKVNETKAMVKFQLKKVLCMGVAVGNVAMEEKQVFQNVQMSVNFLVSLLKKNWQNVRSLSLKTTMGRPVRVY

SEQ ID NO: 25977 - protein, 216 aa, Carpinus betulus
MSKLQSETLREVISQVLNAAKEKNRKFTETVELQIGLKNYDPQKDKRFSGSVKLPHIPRPKMKVCMLGDAQHVEEAEKIGLEYMDVEALKKLNKNKKLVKKLAKKYHAFLASESVIKQIPRLLGPGLNKAGKFPTLVTHQETLESKVIEVKAMVKFQLKKVLCMGVAVGNCSMEEKQLFQNVQMSINFLVSLLKKNWQNVRCLHLKSTMGSAIRLY

SEQ ID NO: 25978 - protein, 213 aa, Euphorbia peplus
LQSEALREAITTIMTASKEKKRNFTETIELQIGLKNYDPQKDKRFSGSVKLPHIPRPKMKVCMLGDAQHVEEATAIGLQWMDVEALKKLNKNKKLVKKLAKQYHAFLASESVIKQIPRLLGPGLNKAGKFPTLVTHQESLESKVNETKATVKFQLKKVLCMGVAVGNCAMEEKQVFQNVQMSVNFLVSLLKKNWQNVKCLNLKTTMGSPQRVF

SEQ ID NO: 25979 - protein, 216 aa, Jatropha curcas
MSKLQSETLREAISTIMAASVEKKRNFTETIELQIGLKNYDPQKDKRFSGSVKLPHIPRPKMKICMLGDAQHVEEAEAIGLQWMDVEALKKLNKNKKLVKKLAKQYHAFLASESVIKQIPRLLGPGLNKAGKFPTLVTHQESLESKVNETKATVKFQLKKVLCMGVAVGNCAMEEKQVFQNVQMSVNFLVSLLKKNWQNVKCLNVKTTMGNPVRIF

SEQ ID NO: 25980 - protein, 216 aa, Castanea mollissima
MSKLQSDTLREAISTLFTGSKDKKRNFTETIELQIGLKNYDPQKDKRFSGSVKLPHIPRPKMKVCMLGDAQHVEEAEKMGLDYMDVEALKKLNKNKKLVKKLAKKYHAFLASESVIKLIPRLLGPGLNKAGKFPTLVTHQESIDSKVNETKAMVKFQLKKVLCMGVAVGNVAMEEKQVFQNVQMSVNFLVSLLKKNWQNVRSLSLKTTMGRPVRVY

SEQ ID NO: 25981 - protein, 216 aa, Populus trichocarpa
MSKLAGDTIREAVTTIKNGVNEKPRKFVQTIELQIGLKNYDPQKDKRFSGSVKLPHIPRPKMKVCMLGDAQHVEEATSIGLQWMDVEALKKLNKNKKLVKKLSKQYHAFLASESVIKQIPRLLGPGLNKAGKFPTLVTHQESLESKVNEIKATVKFQLKKVLCMGVAVGNCDMEDKQIFQNVQMSVNFLVSLLKKNWQNVKSLHLKSTMGTPVRLY

SEQ ID NO: 25982 - protein, 208 aa, Chrysanthemum coronarium
REAITSITTDAKEKKVRNFTETIELQIGLKNYDPQKDKRFSGTVRLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 25983 - protein, 199 aa, Musa acuminata
MSKLQSDVLREAISQVVGDSREKKRKFTETVELQIGLKNYDPQKDKRFSGSVKLPHIPRPKMKVCMLGDAQHVEEAEKIGLDYMDVESLKKMNKNKKLVKKLAKKYHAFLASEAIIKQIPRLLGPGLNKAGKFPTLVTHQESLEAKVNETKAMVKFQLKKVLCMGVAVGNCAMEEKQIFQNVQLSVNFLVSLLKKNWQN

SEQ ID NO: 25984 - protein, 202 aa, Adiantum capillus-veneris
MSKLQSDVLREAITQLVSESKEKKRKFVETVELQIGLKNYDPQKDKRFSGSVKLAHIPRPKMKVCMLGDAQHVEEAEKIGLDCMDVDALKKMNKNKKLVKKLAKKYHAFLASEAVIKQIPRLLGPGLNKAGKFPTLVSHQESLEGKLNETKATVKFQLKKVLCMGVAVGNLEMEEKQLFQNVQLSVNFLVSLLKKNWQNVRV

SEQ ID NO: 25985 - protein, 216 aa, Populus trichocarpa
MSKLAGDTIREAVTTIKNGVNEKPRKFTQTIELQIGLKNYDPQKDKRFSGSVKLPHIPRPKMKVCMLGDAQHVEEAVSIGLQWMDVEALKKLNKNKKLVKKLSKQYHAFLASESVIKQIPRLLGPGLNKAGKFPTLVTHQESLESKVNEIKATVKFQLKKVLCMGVAVGNCDMEDKQIFQNVQMSVNFLVSLLKKNWQNVKSLHLKSTMGTPVRLY

SEQ ID NO: 25986 - protein, 194 aa, Zingiber officinale
KKRNFTETIELQIGLKNYDPQKDKRFSRSVKLPHIPRPKMKVCMLGDAQHIEEAEKIGLDYMDVESLKKMNKNKKLVKKLAKKYHAFLASEAIIKQIPRLLGPGLNKAGKFPTLVSHQETLESKVNETKAMVKFQLKKVLCMGVAVGNVAMEEKQIFQNVQMSVNLLVSLLKKNWQNVRCLYLKSTMGKPYRIF

SEQ ID NO: 25987 - protein, 176 aa, Leymus cinereus x Leymus triticoides
DPQKDKRFSGSVKLPHIPRPKMRVCMLGDAQHVEEAGKMGLDCMDVESLKKMNKNKKLVKKLAKKYHAFLASEAIIKQIPRLLGPGLNKAGKFPTLVSHQESLESKVNETKATVKFQLKKVLCMGVAVGHLGMEEKQIFQNVQMSVNFLVSLLKKNWQNVRCLYLKSTMGKVYRLF

SEQ ID NO: 25988 - protein, 204 aa, Thalictrum flavum
ITQVTGEAKEKKRKFTETVELQIGLKNYDPQKDKRFSGSVKLPHIPRPKMKICMLGDAQHVEEAEKIGLEYMDVEGLKKLNKNKKLVKKLAKKYHAFLASEAVIKQIPRLLGPGLNKAGKFPTLVTHQESLESKVNESKAMVKFQLKKVLCMGVAVGNLGMDEKQIFQNVQLSVNFLVSLLKKNWQNVRCLYLKSSMGKPFRIF

SEQ ID NO: 25989 - protein, 208 aa, Euphorbia peplus
LREAITTIMTASKEKKRNFTETIELQIGLKNYDPQKDKRFSGSVKLPHIPRPKMKVCMLGDAQHVEEATAIGLQWMDVEALKKLNKNKKLVKKLAKQYHAFLASESVIKQIPRLLGPGLNKAGKFPTLVTHQESLESKVNETKATVKFQLKKVLCMGVAVGNCAMEEKQVFQNVQMSVNFLVSLLKKNWQNVKCLNLKTTMGSPQRVF

SEQ ID NO: 25990 - protein, 238 aa, Eragrostis curvula
MKNVAKCDTWCELQNPANHRVFERKLQTEVLKDGIANVVKDAKEKNRKFTETIELQIGLKNYDPQKDKRFSGSVKLPHIPRPKMKVCMLGDAQHVEEAEKMGLDYMDVESLKKMNKNKKLVKKLAKKYHAFLASEAIIKQIPRLLGPGLNKAGKFPTLVSHQESLESKVNETKATVKFQLKKVLCMGVAVGNLSMEEKQIQQNIQMSVNFLVSLLKKNWQNVRCLYIKSTMGKPYRLF

SEQ ID NO: 25991 - protein, 204 aa, Ambrosia trifida
MSKLQSEALREAITQITTDAKEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQMCGACT

SEQ ID NO: 25992 - protein, 194 aa, Brassica rapa
KPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLEAKVNETKATVKFQLKKVLCMGVAVGNLDMEEKQIFQNVQMSVNFLVSLLKKNWQNVRCLYLKSTMGPPNRVF

SEQ ID NO: 25993 - protein, 155 aa, Sorghum bicolor
MDVSGAGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNIHSVLLPKKVAEKAAKEPKSPKKAAKSPKKA

SEQ ID NO: 25994 - protein, 157 aa, Sorghum bicolor
MDASGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKVAEKAASGGSKEAKSPKKAAKSPKKA

SEQ ID NO: 25995 - protein, 159 aa, Sorghum bicolor
MDVSGAGSGGKAKKGAGGRKTGGGPRKKSVTRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNIHSVLLPKKVAEKAAAAAKEPKSPKKAAKSPKKA

SEQ ID NO: 25996 - protein, 156 aa, Zea mays
MDASAAGAGGKAKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLSGVTIAHGGVLPNINPVLLPKKTAEKAAAKEAKSPKKAAKSPKKA

SEQ ID NO: 25997 - protein, 150 aa, Beta vulgaris
MDTAGGKGKKGAAGRKGGGPKKKPVSRSVKAGLQFPVGRIGRYLKKGRYAQRVGTGAPVYLAAVLEYLAAEVLELAGNAARDNKKNRIIPRHVLLAVRNDDELGKLLAGVTIAHGGVLPNINPVLLPKKTAEKAAKEPKSPKAAKSPKKA

SEQ ID NO: 25998 - protein, 157 aa, Gossypium hirsutum
  Sequence also found in Organisms: Zea mays
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASGGSKEPKSPKKGAKSPKKA

SEQ ID NO: 25999 - protein, 159 aa, Cenchrus ciliaris
MDATGTGAGGKVKKGAAGRKAGGPRKKSVSRSVKAGLQFPVGRIGRYLKKGRYAQRVGTGAPVYLAAVLEYLAAEVLELAGNAARDNKKSRIIPRHVLLAIRNDEELGKLLAGVTIAHGGVLPNINPVLLPKKTAEKASSGGSKEAKSPKKAAKSPKKA

SEQ ID NO: 26000 - protein, 155 aa, Lotus japonicus
MDSTATGKVKKGAAGRKAGGPKKKSVSRSVKAGLQFPVGRIGRYLKKGRYAQRVGSGAPVYLAAVLEYLAAEVLELAGNAARDNKKNRIIPRHVLLAVRNDEELGKLLAGVTIAHGGVLPNINPVLLPKKTAEKAPKEPKSPAKKAAKSPKKAAA

SEQ ID NO: 26001 - protein, 155 aa, Festuca arundinacea
MDVSSTAAGGKAKKGAAGRKAGGPRKKSVTRSVKAGLQFPVGRVGRYLKKGRYAPRVGTGAPVYLAAVLEYLAAEVLELAGNAAKDNKKSRIIPRHLLLAVRNDEELGKLLAGVTIAHGGVLPKINPVLLPKKTADKAAKEPKSPKKTAKSPKKA

SEQ ID NO: 26002 - protein, 151 aa, Panicum virgatum
MDAGAPKVKKAAAGRKLGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNIHSVLLPKKAAEKAEKAAKSPKKAAAKSPKK

SEQ ID NO: 26003 - protein, 159 aa, Zea mays
MDSTGTGAGGKGKKGAAGRKVGGPRKKSVSRSVKAGLQFPVGRIGRYLKKGRYAQRVGTGAPVYLAAVLEYLAAEVLELAGNAARDNKKTRIIPRHVLLAIRNDEELGKLLGGVTIAHGGVLPNINPVLLPKKTAEKASSVGSKEAKSPKKAAKSPKKA

SEQ ID NO: 26004 - protein, 159 aa, Pennisetum glaucum
MDATGTGAAGKVKKGAAGRKAGGPRKKSVSRSVKAGLQFPVGRIGRYLKKGRYAQRVGTGAPVYLAAVLEYLAAEVLELAGNAARDNKKSRIIPRHVLLAIRNDEELGKLLAGVTIAHGGVLPNINPVLLPKKTAEKASSGGSKEAKSPKKAAKSPKKA

SEQ ID NO: 26005 - protein, 151 aa, Lotus japonicus
MDTGGKSKKGAGGRKAGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTAEKAPKESKSPPKKAGKSPKKA

SEQ ID NO: 26006 - protein, 149 aa, Vigna unguiculata
MDAGGKIKKGAGGRKGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTEKASKEPKSPSKATKSPKKA

SEQ ID NO: 26007 - protein, 149 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERAAKEPKSPSKATKSPKKA

SEQ ID NO: 26008 - protein, 152 aa, Zingiber officinale
MDASGATAGKAKKGAAGRRAGGPKKKAVSRSTKAGLQFPVGRIGRFLKKGRYAQRVGSGAPVYLAAVLEYLAAEVLELAGNAARDNKKNRIIPRHVLLAIRNDEELGKLLAGVTIAHGGVLPNINPVLLPKKTAAKEPKSPSKATKSPKKAA

SEQ ID NO: 26009 - protein, 159 aa, Oryza sativa
MDAAGAGAGGKLKKGAAGRKAGGPRKKAVSRSVKAGLQFPVGRIGRYLKKGRYAQRIGTGAPVYLAAVLEYLAAEVLELAGNAARDNKKNRIIPRHVLLAIRNDEELGKLLAGVTIAHGGVLPNINPVLLPKKTAEKAAAAGKEAKSPKKAAGKSPKKA

SEQ ID NO: 26010 - protein, 159 aa, Panicum virgatum
MDSTGTGAGGKVKKGAAGRKTGGPRKKAVSRSVKAGLQFPVGRIGRYLKKGRYAQRVGTGAPVYLAAVLEYLAAEVLELAGNAARDNKKTRIIPRHVLLAIRNDEELGKLLSGVTIAHGGVLPNINPVLLPKKTAEKASSGGSKEAKSPKKAAKSPKKA

SEQ ID NO: 26011 - protein, 160 aa, Sorghum bicolor
MDSTGAGAGGKVKKGAGGRKAGGGPRKKSVSRSVKAGLQFPVGRIGRYLKKGRYAQRVGTGAPVYLAAVLEYLAAEVLELAGNAARDNKKTRIIPRHVLLAIRNDEELGKLLSGVTIAHGGVLPNINPVLLPKKTAEKASSGGSKEPKSPKKAAKSPKKA

SEQ ID NO: 26012 - protein, 149 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERASKEPKSPSKATKSPKKA

SEQ ID NO: 26013 - protein, 149 aa, Vigna unguiculata
MDTGGKIKKGAGGRKGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTEKASKEPKSPSKATKSPKKA

SEQ ID NO: 26014 - protein, 149 aa, Vigna unguiculata
MDAGGKIKKGAGGRKGGGPKKKPVARSVRAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTEKASKEPKSPSKATKSPKKA

SEQ ID NO: 26015 - protein, 149 aa, Camellia sinensis
MDAGGKVKKGAAGRKGGGPKKKPVSRSVKAGLQFPVGRISRYLKKGRYSQRVGTGAPVYLAAVLEYLAAEVLELAGNAARDNKKNRIIPRHVLLAVRNDEELGKLLAGVTIAHGGVLPNINPVLLPKKNEKATKEPKSPSKATKSPKKA

SEQ ID NO: 26016 - protein, 159 aa, Zea mays
MDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLTGVTIAHGGVLPNINPVLLPKKTAEKASSGGSKEAKSPKKAAKSPKKA

SEQ ID NO: 26017 - protein, 149 aa, Centaurea maculosa
MDTTGKVKKGAAGRKAGGPRKKSVTRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPILLPKKTATKEPKSPSKAAKSPKKAAA

SEQ ID NO: 26018 - protein, 153 aa, Beta vulgaris
MDSTAGGKAKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDDELGKLLSGVTIAHGGVLPNINPVLLPKKAGGDKATKEPKSPSKATKSPKKA

SEQ ID NO: 26019 - protein, 152 aa, Lotus japonicus
MDTTTGKAKKGAGGRKIGGPKKKPVSRSIKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTAEKVAKEPKSPAKKGVKSPKKA

SEQ ID NO: 26020 - protein, 149 aa, Glycyrrhiza uralensis
MDASGKVKKGAGGRKGGGPKKKAVTRSVRAGLQFPVGRIGRYLKKGRYAQRVGAGAPVYLAAVLEYLAAEVLELAGNAARDNKKNRIIPRHVLLAVRNDEELGKLLAGVTIAHGGVLPNINPVLLPKKADRAAKEPKSPSKATKSPKKA

SEQ ID NO: 26021 - protein, 159 aa, Panicum virgatum
MDNTGTGAGGKVKKGAGGRKTGGPRKKSVTRSVKAGLQFPVGRIGRYLKKGRYAQRVGSGAPVYLAAVLEYLAAEVLELAGNAARDNKKTRIIPRHVLLAIRNDEELGKLLSGVTIAHGGVLPNINPVLLPKKTAEKASSGGSKEAKSPKKAAKSPKKA

SEQ ID NO: 26022 - protein, 148 aa, Artemisia annua
EGTGKIKKGAAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKEPTPKSPSKAAKSPKKA

SEQ ID NO: 26023 - protein, 148 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTQVAKEPKSPSKATKSPKKA

SEQ ID NO: 26024 - protein, 149 aa, Cenchrus ciliaris
KVKKGAAGRKAGGPRKKSVSRSVKAGLQFPVGRIGRYLKKGRYAQRVGTGAPVYLAAVLEYLAAEVLELAGNAARDNKKSRIIPRHVLLAIRNDEELGKLLAGVTIAHGGVLPNINPVLLPKKTAEKASSGGSKEAKSPKKAAKSPKKA

SEQ ID NO: 26025 - protein, 151 aa, Persea americana
MEGGGKVKKGVAGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVIPNINPVLLPKKTAEKAAKEPKSPAKAPKSPKKAA

SEQ ID NO: 26026 - protein, 151 aa, Actinidia deliciosa
MDAGGKAKKGAAGRRGGGPKKKPVSRSVKAGLQFPVGRIGRYLKKGRYAQRVGTGAPVYMAAVLEYLAAEVLELAGNAARDNKKNRIIPRHVLLAIRNDEELGRLLAGVTIAHGGVLPNINPVLLPKKTDKAATKEPKSPSKATKSPKKAA

SEQ ID NO: 26027 - protein, 151 aa, Nicotiana tabacum
MDTSGKAKKGAAGRRVGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKTGGEKAGKEHKSPSKATKSPKKA

SEQ ID NO: 26028 - protein, 151 aa, Nicotiana tabacum
MDTSGKAKKGAAGRRGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKTGGDKAGKEPKSPSKATKSPKKA

SEQ ID NO: 26029 - protein, 149 aa, Manihot esculenta
MESGGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSEKAAKEPKSPSKATKSPKKA

SEQ ID NO: 26030 - protein, 150 aa, Liriodendron tulipifera
MESTGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLHGVTIAHGGVLPNINPVLLPKKTAEKAAKEPKSPTKAAKSPKKA

SEQ ID NO: 26031 - protein, 150 aa, Medicago truncatula
MDASTKATKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKSEKPVKEPKSPSKAKKSPKKA

SEQ ID NO: 26032 - protein, 149 aa, Populus trichocarpa
METGGKVKKGAAGRKGGGPKKKPVSRSAKAGLQFPVGRIGRYLKKGRYSQRVGSGAPVYLAAVLEYLAAEVLELAGNAARDNKKNRIIPRHVLLAVRNDEELGKLLAGVTIAHGGVLPNINPVLLPKKTEKAAKEPKSPSKATKSPKKA

SEQ ID NO: 26033 - protein, 149 aa, Glycine max
MDTGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERASKEPKSPSKATKSPKKS

SEQ ID NO: 26034 - protein, 148 aa, Gerbera hybrid cultivar
MDGAGKAKKGAGGRKGGGPRKKAVTRSVKAGLQFPVGRIGRFLKKGRYAQRVGSGAPVYLAAVLEYLAAEVLELAGNAARDNKKNRIIPRHVLLAIRNDEELGKLLAGVTIAHGGVLPNINPVLLPKKAAAAKEPKSPSKATKSPKKA

SEQ ID NO: 26035 - protein, 148 aa, Medicago truncatula
MDASTKTKKGAGGRKGGPRKKSVTRSTRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKNEKAATTTKSPSKATKSPKKA

SEQ ID NO: 26036 - protein, 150 aa, Arachis hypogaea
MDAASKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTAEKAPKETKSPSKATKSPKKA

SEQ ID NO: 26037 - protein, 164 aa, Zea mays
MDASGAGSKAKKGAAGRKAGGPRKKSVSRSVKAGLQFPVGRIGRYLKKGRYAQRVGTGAPVYLAAVLEYLAAEVLELAGNAAKDNKKTRIVPRHVLLAIRNDVELGKLLAGVTIAHGGVLPNINPVLLPKKVAEKASSGGSKESKSPKKAAKSPKKAAKSPKKA

SEQ ID NO: 26038 - protein, 149 aa, Artemisia annua
MEGTGKIKKGAAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKEPTPKSPSKAGKSPKKA

SEQ ID NO: 26039 - protein, 156 aa, Oryza sativa
MDVGVGGKAAKKAVGRKLGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPVLLPKKTAEKADKPAKASKDKAAKSPKKQARS

SEQ ID NO: 26040 - protein, 147 aa, Gerbera hybrid cultivar
MDGAGKAKKGAGGRKGGGPRKKAVTRSVRAGLQFPVGRIGRFLKKGRYAQRVGTGAPVYLAAVLEYLAAEVLELAGNAARDNKKNRIIPRHVLLAIRNDEELGKLLAGVTIAHGGVLPNINPILLPKKTAAKEPKSPSKSTKSPKKA

SEQ ID NO: 26041 - protein, 146 aa, Gerbera hybrid cultivar
MDGAGKVKKGAGGRKGGPRKKAVTRSVRAGLQFPVGRIGRFLKKGRYAQRVGTGAPVYLAAVLEYLAAEVLELAGNAARDNKKNRIIPRHVLLAIRNDEELGKLLAGVTIAHGGVLPNINPILLPKKTAAKEPKSPSKSAKSPKKA

SEQ ID NO: 26042 - protein, 153 aa, Persea americana
MEGGGKVKKGAAGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVIPNINPVLLPKKTAEKAAKEPKSSSKAPKSPKKAAAA

SEQ ID NO: 26043 - protein, 152 aa, Catharanthus roseus
MDTAGKVKKGAAGRKGGGPKKKPVTRSTRAGLQFPVGRIGRYLKKGRYSQRVGTGAPVYMAAVLEYLAAEVLELAGNAARDNKKNRIIPRHVLLAIRNDEELGKLLAGVTIAHGGVLPNINPVLLPKKSGEKVATKEPKSPSKATKSPKKAA

SEQ ID NO: 26044 - protein, 153 aa, Trifolium pratense
MDSTTNTKTKKGAAGRKGGGPRKKSVTRSTRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKTDRSTSASKEPKSPKAGKSPKKA

SEQ ID NO: 26045 - protein, 151 aa, Nicotiana benthamiana
MDTSGKAKKGAAGRRGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKTGSDKAGKDPKSPSKATKSPKKA

SEQ ID NO: 26046 - protein, 150 aa, Jatropha curcas
MDAGAKVKKGAGGRKGGGPKKKPTSRSVKAGLQFPVGRIGRYLKKGRYAQRVGSGAPVYLAAVLEYLAAEVLELAGNAARDNKKNRIIPRHVLLAVRNDEELGKLLAGVTIAHGGVLPNINPVLLPKKSEKAATKEPKSPSKGTKSPKKA

SEQ ID NO: 26047 - protein, 151 aa, Tragopogon dubius
METSGKLKKGAAGRKAGGPKKKSVTRSVKAGLQFPVGRIGRYIKNGRYAKRVGTGAPVYLAAVLEYLAAEVLELAGNAARDNKKSRIIPRHVLLAVRNDEELGKLLAGVTIAHGGVLPNINPVLLPKKNLDKAEKETTKSPKKAAKSPKKA

SEQ ID NO: 26048 - protein, 151 aa, Orobanche aegyptiaca
MDASGKVKKGAAGRKIGGGPRKKSVTRSVRAGLQFPVGRIGRYLKKGRYAQRVGTGAPVYVAAVLEYLAAEVLELAGNAARDNKKNRIIPRHLLLAVRNDEELGKLLAGVTIAHGGVIPNINPVLLPKKNEKVGEKAPKSPAKATKSPKKA

SEQ ID NO: 26049 - protein, 151 aa, Gerbera hybrid cultivar
MDAGTKVKKGAAGRKAGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVIPNINPVLLPKKAHDKATKEPAKSPSKATKSPKKG

SEQ ID NO: 26050 - protein, 149 aa, Bruguiera gymnorhiza
MDTTAKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSEKAIKEPKSPSKATKSPKKA

SEQ ID NO: 26051 - protein, 149 aa, Manihot esculenta
METGGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSDKAAKEPKSPSKATKSPKKA

SEQ ID NO: 26052 - protein, 149 aa, Manihot esculenta
METGGKVKKGAGGRKGGGPKKKPTSRSVRAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTEKATKEPKSPSKATKSPKKA

SEQ ID NO: 26053 - protein, 153 aa, Pseudoroegneria spicata
MDASGTVAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKAPKSPKKAAKSPKKA

SEQ ID NO: 26054 - protein, 150 aa, Triphysaria pusilla
METGGKAKKGAAGRKAGGPKKKSVSRSVKAGLQFPVGRIGRFLKKGRYAQRVGSGAPVYLAAVLEYLAAEVLELAGNAARDNKKSRIIPRHLLLAVRNDEELGKLLAGVTIAHGGVIPNINPVLLPKKSDKVAEKAPKSPSKATKSPRKA

SEQ ID NO: 26055 - protein, 150 aa, Helianthus annuus
MDAGGKLKKGAAGRKAGGPKKKPVTRSVKAGLQFPVGRIGRYLKVGRYAKRVGTGAPVYLAAVLEYLAAEVLELAGNAARDNKKNRINPRHVLLAVRNDDELGKLLAGVTIAHGGVLPNINPVLLPKKSHDKAAKEPKSPAKPTKSPKKA

SEQ ID NO: 26056 - protein, 150 aa, Triphysaria pusilla
METGGKVKKGAAGRKAGGPKKKSVTRSVKAGLQFPVGRIGRFLKKGRYAQRVGSGAPVYLAAVLEYLAAEVLELAGNAARDNKKSRIIPRHLLLAVRNDEELGKLLAGVTIAHGGVIPNINPVLLPKKSDKVAEKAPKSPSKAAKSPKKA

SEQ ID NO: 26057 - protein, 154 aa, Brachypodium distachyon
MDTGAGKAKKGAGGRKAGGGGGPRKKSVTRSVKAGLQFPVGRIGRYLKKGRYAQRVGSGAPVYLAAVLEYLAAELLELAGNAARDNKKTRIIPRHLLLAIRNDDELGKLLAGVTIAHGGVMPKINQVLLPKKTAAKEPKEPKSPKKAAKSPKKA

SEQ ID NO: 26058 - protein, 148 aa, Cynara scolymus
MEGTGKVKKGAGGRKGGGPRKKSVTRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPILLPKKTATKEPKSPSKAAKSPKKTA

SEQ ID NO: 26059 - protein, 147 aa, Elaeis guineensis
MEIGGKLKKGAGGRRGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTASKEPKSPTKATKSPKKA

SEQ ID NO: 26060 - protein, 152 aa, Petunia hybrida
METGGKVKKGAAGRRGGGPKKKPVSRSVRAGLQFPVGRIGRYLKKGRYAQRVGTGAPVYLAAVLEYLAAEVLELAGNAARDNKKNRIIPRHLLLAVRNDEELGKLLAGVTIAHGGVLPNINPVLLPKKTGGSEKAGKEPKSPSKATKSPKKA

SEQ ID NO: 26061 - protein, 150 aa, Malus domestica
METGGKLKKGAGGRKGGGPKKKAVTRSVRAGLQFPVGRIGRYLKKGRYAQRVGSGAPVYLAAVLEYLAAEVLELAGNAARDNKKNRIIPRHLLLAVRNDEELGKLLAGVTIAHGGVLPNINPVLLPKKSEKAAGKEPKSPSKATKSPKKA

SEQ ID NO: 26062 - protein, 150 aa, Malus domestica
METGGKLKKGAGGRKGGGPKKKAVTRSVRAGLQFPVGRIGRYLKKGRYAQRVGSGAPVYLAAVLEYLAAEVLELAGNAARDNKKNRIIPRHLLLAVRNDEELGKLLAGVTIAHGGVLPNINPVLLPKKSEKAAGKEPKSPTKATKSPKKA

SEQ ID NO: 26063 - protein, 151 aa, Orobanche aegyptiaca
MEAGGKVKKGAAGRKIGGGPRKKSVTRSVRAGLQFPVGRIGRYLKKGRYAQRVGTGAPVYVAAVLEYLAAEVLELAGNAARDNKKNRIIPRHLLLAVRNDEELGKLLAGVTIAHGGVIPNINPVLLPKKNEKTAEKTPKSPAKAAKSPKKA

SEQ ID NO: 26064 - protein, 150 aa, Panax ginseng
METGGKLKKGAAGRKGGGPKKKPVSRSVKAGLQFPVGRIGRYLKKGRYAQRVGTGAPVYLAAVLEYLAAEVLELAGNAARDNKKNRIIPRHLLLAVRNDEELGKLLAGITIAHGGVLPNINPVLLPKKSEKAAKEPTKSPSKATKSPKKA

SEQ ID NO: 26065 - protein, 152 aa, Catharanthus roseus
MDTATGKMKKGAAGRRGGGPKKKPVSRSSRAGLQFPVGRIGRYLKKGRYSQRVGTGAPVYMAAVLEYLAAEVLELAGNAARDNKKNRIIPRHVLLAVRNDEELGKLLAGVTIAHGGVLPNINPVLLPKKNEKAAAKEPAKSPAKGTKSPKKA

SEQ ID NO: 26066 - protein, 150 aa, Citrus clementina
MESGGKVKRGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSEKAATKEPKSPAKATKSPKKA

SEQ ID NO: 26067 - protein, 150 aa, Castanea mollissima
  Sequence also found in Organisms: Quercus alba
MDTGGKVKRGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTEKAATKEPKSPARATKSPKKA

SEQ ID NO: 26068 - protein, 150 aa, Gossypium hirsutum
  Sequence also found in Organisms: Gossypium raimondii
METSGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTEKAAGKEPKSPSKATKSPKKA

SEQ ID NO: 26069 - protein, 151 aa, Arachis hypogaea
MDSPAVKGKKGAAGRRGGGPKKKSVSRSAKAGLQFPVGRIGRYLKKGRYAQRLGSGAPVYLAAVLEYLVAEVLELAGNAARDNKKNRIIPRHVLLAVRNDEELGKLLAGVTIAHGGVLPNINPVLLPKKSQAAAAKEPKSPSKGTKSPKKA

SEQ ID NO: 26070 - protein, 150 aa, Triphysaria pusilla
MEATPKAKKGAAGRKAGGPKKKSVTRSVKAGLQFPVGRIGRFLKKGRYAQRVGSGAPVYLAAVLEYLAAEVLELAGNAARDNKKSRIIPRHLLLAVRNDEELGKLLAGVTIAHGGVIPNINPVLLPKKSDKVAEKAPKSPSKAAKSPRKA

SEQ ID NO: 26071 - protein, 150 aa, Triphysaria pusilla
METGGKVKKGAAGRKAGGPKKKSVTRSVKAGLQFPVGRIGRFLKKGRYAQRVGSGAPVYLAAVLEYLAAEVLELAGNAARDNKKSRIIPRHLLLAVRNDEELGKLLAGVTIVHGGVIPNINPVLLPKKSDKVAEKAPKSPSKAAKSPKKA

SEQ ID NO: 26072 - protein, 149 aa, Cicer arietinum
MDTSPKSKRGAGGRKGGGPRKKAVTRSTRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKNERAVKEPKSPSKAVKSPKKA

SEQ ID NO: 26073 - protein, 151 aa, Ipomoea nil
MDAPAAKIKKGAGGRKGGGPKKKPVTRSVRAGLQFPVGRIGRYLKKGRYAQRVGTGAPVYMAAVLEYLAAEVLELAGNAARDNKKNRIIPRHVLLAVRNDEELGKLLAGVTIAHGGVLPNINPVLLPKKSGSEATKEPKAKAAKSPKKKAA

SEQ ID NO: 26074 - protein, 149 aa, Tropaeolum majus
MDTTGKAKKGAGGRKGGGPKKKSVTRSVRAGLQFPVGRIGRYLKKGRYAARVGTGAPVYLAAVLEYLAAEVLELAGNAARDNKKSRIIPRHLLLAVRNDEELGKLLSGVTIAHGGVLPNINPILLPKKTEKSAHEPKSPAKAGKSPKKA

SEQ ID NO: 26075 - protein, 149 aa, Helianthus annuus
MEATGKAKKGAAGRKAGGPRKKAVTRSIRAGLQFPVGRIGRYLKNGRYAKRVGTGAPVYLAAVLEYLAAEVLELAGNAARDNKKNRINPRHVLLAIRNDDELGKLLAGVTIAHGGVLPNINPVLLPKKTAAKEPKSPAKATKSPKKAAA

SEQ ID NO: 26076 - protein, 148 aa, Cynara scolymus
METTGKAKKGAGGRKGGGPRKKAVTRSIRAGLQFPVGRIGRYLKNGRYAKRVGTGAPVYLAAVLEYLAAEVLELAGNAARDNKKNRIIPRHVLLAIRNDDELGKLLAGVTIAHGGVLPNINPVLLPKKTAAKEPKSPSKATKSPKKAD

SEQ ID NO: 26077 - protein, 148 aa, Helianthus annuus
MESTGKVKKGAAGRKAGGPRKKAVTRSVKAGLQFPVGRIGRFLKKGRYAQRVGSGAPVYLAAVLEYLAAEVLELAGNAARDNKKNRIIPRHVLLAIRNDEELGKLLAGVTIAHGGVLPNINPILLPKKTAAKEPKSPSKAAKSPKKAK

SEQ ID NO: 26078 - protein, 144 aa, Helianthus annuus
MEAKKGAGGRKAGGPKKKPVSRSVKAGLQFPVGRLGRYLKKGRYAQRVGTGAPVYLAAVLEYLAAEVLELAGNAARDNKKNRIIPRHVLLAVRNDEELGKLLAGVTIAHGGVLPNINPVLLPKKAAAKEATKSPAKVTKSPKKA

SEQ ID NO: 26079 - protein, 153 aa, Heritiera littoralis
MDAGGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKNEKAVKEPKSPSKATKSPKKSLKKA

SEQ ID NO: 26080 - protein, 161 aa, Brachypodium distachyon
MDVSGTGAGKAKKGAAGRKAGGPRKKSVTRSVRAGLQFPVGRIGRYLKKGRYAQRVGTGAPVYMAAVLEYLAAEVLELAGNAARDNKKSRIIPRHVLLAVRNDDELGKLLAGVTIAHGGVLPKINPILLPKKTAEKAPKEPKSPKKAATPKKADAKSPKKA

SEQ ID NO: 26081 - protein, 153 aa, Senecio madagascariensis
MEAGGKAKKGAAGRKAGGPRKKSVTRSVKAGLQFPVGRIGRYLKKGRYAKRVGTGAPVYLAAVLEYLAAEVLELAGNAARDNKKTRIIPRHVLLAVRNDEELGKLLAGVTIAHGGVLPNINPVLLPKKSQSGKEPASKSPVKATKSPKKGAAA

SEQ ID NO: 26082 - protein, 152 aa, Catharanthus roseus
  Sequence also found in Organisms: Rosmarinus officinalis
METAGKVKKGAAGRKGGGPKKKPVTRSTRAGLQFPVGRIGRYLKKGRYSQRVGTGAPVYMAAVLEYLAAEVLELAGNAARDNKKNRIIPRHVLLAIRNDEELGKLLAGVTIAHGGVLPNINPVLLPKKTGEKVATKEPKSPSKATKSPKKAA

SEQ ID NO: 26083 - protein, 155 aa, Pseudoroegneria spicata
MDASATVATGKAKKGAAGRKAGGPRKKSVSRSVKAGLQFPVGRIGRFLKKGRYAQRVGSGAPVYLAAVLEYLAAELLELAGNAAKDNKKSRIIPRHLLLAIRNDEELGKLLAGITIAHGGVIPNINPLLLPKKTAEKSPKEPKSPKKTTKSPKKA

SEQ ID NO: 26084 - protein, 147 aa, Elaeis guineensis
METGGKVKKGAGGRRGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTASKEPKSPSKATKSPKKA

SEQ ID NO: 26085 - protein, 150 aa, Ricinus communis
MESGGKVKKGAGGRKGGGPKKKPVTRSVRAGLQFPVGRIGRYLKKGRYAQRVGTGAPVYMAAVLEYLAAEVLELAGNAARDNKKNRIIPRHVLLAVRNDEELGKLLAGVTIAHGGVLPNINPVLLPKKTEKATKEPTKSPSKATKSPKKA

SEQ ID NO: 26086 - protein, 150 aa, Ricinus communis
METGGKVKKGAGGRKGGGPKKKPVTRSVRAGLQFPVGRIGRYLKKGRYAQRVGTGAPVYMAAVLEYLAAEVLELAGNAARDNKKNRIIPRHVLLAVRNDEELGKLLAGVTIAHGGVLPNINPVLLPKKTEKATKEPTKSPSKATKSPKKA

SEQ ID NO: 26087 - protein, 151 aa, Artemisia annua
MEGTGKIKKGAAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKESTPKSPSKVGKSPKKAAA

SEQ ID NO: 26088 - protein, 151 aa, Antirrhinum majus
MEAGGKLKKGAGGRKGGGPKKKPVTRSVRAGLQFPVGRIGRYLKKGRYAQRVGTGAPVYMAAVLEYLAAEVLELAGNAARDNKKNRIIPRHVLLAVRNDEELGKLLAGVTIAHGGVLPNINPVLLPKKSEKATTEKATKSPSKATKSPKKA

SEQ ID NO: 26089 - protein, 151 aa, Gossypium hirsutum
  Sequence also found in Organisms: Gossypium raimondii
MDTGSKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKNEKVATKEPKSPSKATKKSPKKA

SEQ ID NO: 26090 - protein, 147 aa, Camellia sinensis
MEKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAVVTIAHGGVLPNINPVLLPKKSEKAAKEPKSPTKAAKSPKRKA

SEQ ID NO: 26091 - protein, 151 aa, Camellia sinensis
MDGAGKVKKGAGGRKGGGPKKKPVSRSVKAGLQFPVGRIGRYLKKGRYAQRVGTGAPVYMAAVLEYLAAEVLELAGNAARDNKKNRIIPRHVLLAVRNDEELGKLLAGVTIAHGGVLPNINPVLLPKKTGSAATKEPKSPSKATKSPKKAA

SEQ ID NO: 26092 - protein, 151 aa, Coffea canephora
MESAGGKVKKGAGGRKGGGPKKKPVSRSVKAGLQFPVGRIGRYLKKGRYSERVGTGAPVYMAAVLEYLAAEVLELAGNAARDNKKNRIIPRHVLLAVRNDEELGKLLAGVTIAHGGVLPNINPVLLPKKNEKAAKEPVKSPAKATKSPKKA

SEQ ID NO: 26093 - protein, 151 aa, Orobanche aegyptiaca
MEVSGKVKKGAAGRKIGGGPRKKSVTRSVRAGLQFPVGRIGRYLKKGRYAQRVGTGAPVYVAAVLEYLAAEVLELAGNAARDNKKNRIIPRHLLLAVRNDEELGKLLAGVTIAHGGVIPNINPILLPKKTDKAAEKTTKSPAKATKSPKKA

SEQ ID NO: 26094 - protein, 150 aa, Panax ginseng
MDNTGKGKKGAGGRKGGGPRKKAVTRSARAGLQFPVGRIGRYLKKGRYAQRLGTGAPVYLAAVLEYLAAEVLELAGNAARDNKKNRIIPRHLLLAVRNDEELGKLLGGVTIAHGGVLPNINPVLLPKKTDKATKEPKSPSKAATKSPKKA

SEQ ID NO: 26095 - protein, 149 aa, Camellia sinensis
MDAAKVKKGAAGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSDKATKEPKSPSRATKSPKKAA

SEQ ID NO: 26096 - protein, 149 aa, Vitis vinifera
MEAAGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSDKAAKEPKSPSKATKSPRKT

SEQ ID NO: 26097 - protein, 149 aa, Ocimum basilicum
METGGKLKKGAGGRKGGGPKKKPVSRSVKAGLQFPVGRIGRYLKKGRYSQRVGTGAPVYMAAVLEYLAAEVLELAGNAARDNKKNRIIPRHVLLAVRNDEELGKLLAGVTIAHGGVLPNINPVLLPKKSGNVAEKTPKSPKATKSPKKA

SEQ ID NO: 26098 - protein, 150 aa, Gossypium hirsutum
  Sequence also found in Organisms: Gossypium raimondii
METTGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTEKAAGKEPKSPSKATKSPKKA

SEQ ID NO: 26099 - protein, 150 aa, Nicotiana tabacum
MDTAGKAKKGAGGRKVGGQSKKPVSRSVKAGLQFPVGRIGRYLKKGRYAQRVGSGAPVYLAAVLEYLAAEVLELAGNAARDNKKNRIIPRHVLLAVRNDEELGKLLAGVTIAHGGVLPNINPILLPKKTGAEKAPKSPAKATKSPRKAAA

SEQ ID NO: 26100 - protein, 150 aa, Triphysaria pusilla
METGGKAKKGAAGRKAGGPKKKSVSRSVKAGLQFPVGRIGRFLKKGRYAQRVGSGAPVYLAAVLEYLAAEVLELAGNAARDNKKSRIIPRHLLLAVRNDEELGKLLAGVTIAHGGVIPNINPVLLPKKTDKGADKEPKSPSKATKSPKKA

SEQ ID NO: 26101 - protein, 150 aa, Juglans hindsii x Juglans regia
METGGKVKRGAAGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKPDKVATKEPKSPSKATKSPKKA

SEQ ID NO: 26102 - protein, 150 aa, Triphysaria pusilla
METGGKVKKGAAGRKAGGPKKKSVTRSVKAGLQFPVGRIGRFLKKGRYAQRVGSGAPVYLAAVLEYLAAEVLELAGNAARDNKKSRIIPRHLLLAVRNDEELGKLLAGVTIAHGGVIPNINPVLLPKKSDKVAEKSPKSPSKATKSPKKA

SEQ ID NO: 26103 - protein, 150 aa, Arachis hypogaea
MDSPAGKTKKGAAGRRGGGPKRKPVSRSVKAGLQFPVGRIGRFLKKGRYSQRVGTGAPVYLAAVLEYLAAEVLELAGNAARDNKKNRIIPRHVLLAVRNDEELGKLLAGVTIAHGGVLPNINPVLLPKKSQTATKEPKSPSKGTKSPKKA

SEQ ID NO: 26104 - protein, 148 aa, Taraxacum officinale
  Sequence also found in Organisms: Helianthus annuus
MESTGKVKKGAAGRKAGGPRKKAVTRSVKAGLQFPVGRIGRFLKKGRYAQRVGSGAPVYLAAVLEYLAAEVLELAGNAARDNKKNRIIPRHVLLAIRNDEELGKLLAGVTIAHGGVLPNINPILLPKKTAAKEPKSPSKATKSPKKAK

SEQ ID NO: 26105 - protein, 153 aa, Medicago truncatula
MDASTKTKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERSNTVSKEPKSPKPKAGKSPKKA

SEQ ID NO: 26106 - protein, 148 aa, Carthamus tinctorius
METTGKAKKGAGGRKGGGPRKKAVTRSIRAGLQFPVGRIGRYLKNGRYAKRVGTGAPVYLAAVLEYLAAEVLELAGNAARDNKKNRIIPRHVLLAIRNDDELGKLLAGVTIAHGGVLPNINPILLPKKTAAKEPKSPSKATKSPKKAD

SEQ ID NO: 26107 - protein, 148 aa, Solanum melongena
MESTGKVKKGAGGRKGGGPKKKPVTRSVKAGLQFPVGRIGRYLKKGRYAQRVGSGAPVYLAAVLEYLAAEVLELAGNAARDNKKNRIIPRHLLLAVRNDEELGKLLAGVTIAHGGVLPNINPVLLPKKTGAEKAPKSPSKATKSPKKA

SEQ ID NO: 26108 - protein, 156 aa, Hordeum vulgare
MDVSGAAAKGKKGAAGRKAGGPRKKSVTRSVKAGLQFPVGRIGRYLKKGRYAQRVGTGAPVFLAAVLEYLAAELLELAGNAAKDNKKSRIIPRHLLLAVRNDEELGKLLAGVTIAHGGVIPKINPVLLPKRTAEKEGKEPKSPKKATKSPKKATKA

SEQ ID NO: 26109 - protein, 148 aa, Medicago truncatula
MEASTKTTKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLNGVTIAHGGVLPNINPILLPKKTEKTAPKEPKKAGKSPKKA

SEQ ID NO: 26110 - protein, 151 aa, Euphorbia peplus
  Sequence also found in Organisms: Euphorbia esula
MDSTTVKKGAGGRKGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKTERSAAAAKEPKSPAKAAKSPKKA

SEQ ID NO: 26111 - protein, 151 aa, Helianthus annuus
METTGKAKKGAAGRKAGGPRKKSVTRSVKAGLQFPVGRIGRYLKHGRYAKRVGTGAPVYLAAVLEYLAAEVLELAGNAARDNKKNRITPRHVLLAIRNDDELGKLLAGVTIAHGGVLPNINPVLLPKKSAAAAKEPNKSPAKTTKSPKKAA

SEQ ID NO: 26112 - protein, 150 aa, Malus domestica
METGGKFKKGAGGRRAGGPKKKPVTRSVRAGLQFPVGRIGRYLKHGRYAQRIGTGAPVYLAAVLEYLAAEVLELAGNAARDNKKNRIIPRHVLLAVRNDEELGKLLKGVTIAHGGVLPNINPVLLPKKHERVAKEPKSPVKAATKSPKKA

SEQ ID NO: 26113 - protein, 151 aa, Actinidia deliciosa
METGGKPKKGAAGRRGGGPKKKPVSRSVKAGLQFPVGRIGRYLKKGRYAQRVGTGAPVYMAAVLEYLAAEVLELAGNAARDNKKNRIIPRHVLLAIRNDEELGKLLAGVTIAHGGVLPNINPVLLPKKTEKASTKEPKSPSKATKSPKKAV

SEQ ID NO: 26114 - protein, 152 aa, Medicago truncatula
MDASTKTTKKGAGGRKGGGPRKKSVTRSIRAGLQFPVGRIGRYLKKGRYAQRVGTGAPVYLAAVLEYLAAEVLELAGNAARDNKKNRIIPRHLLLAVRNDEELGKLLAGVTIAHGGVLPNINPILLPKKTERANTGGKEPKTTKAGKSPKKA

SEQ ID NO: 26115 - protein, 151 aa, Nicotiana benthamiana
MDTAGKAKKGAGGRKAGGQSKKPVSRSVKAGLQFPVGRIGRYLKKGRYAQRVGSGAPVYLAAVLEYLAAEVLELAGNAARDNKKNRIIPRHVLLAVRNDEELGKLLAGVTIAHGGVLPNINPILLPKKTGGAEKEPKSPAKATKSPRKAVA

SEQ ID NO: 26116 - protein, 151 aa, Orobanche aegyptiaca
MEASGKVKKGAAGRKIGGGPRKKSVTRSVRAGLQFPVGRIGRYLKKGRYAQRVGTGAPVYLAAVLEYLAAEVLELAGNAARDNKKNRIIPRHLLLAVRNDEELGKLLAGVTIAHGGVIPNINPILLPKKNDKVGEKTPKSPAKATKSPKKA

SEQ ID NO: 26117 - protein, 151 aa, Artemisia annua
MEGTGKIKKGAAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKESTPKSPSKVGKSPKKTAA

SEQ ID NO: 26118 - protein, 151 aa, Artemisia annua
MEGTGKIKKGVAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKESTPKSPSKVGKSPKKAAA

SEQ ID NO: 26119 - protein, 149 aa, Vitis vinifera
MESTGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLSGVTIAHGGVLPNINPVLLPKKTDKATKEPKSPSKATKSPKKA

SEQ ID NO: 26120 - protein, 150 aa, Prunus persica
  Sequence also found in Organisms: Prunus mume
METGGKVKKGAGGRKGGGPKKKPVTRSVKAGLQFPVGRIGRYLKKGRYAQRVGSGAPVYLAAVLEYLAAEVLELAGNAARDNKKNRIIPRHLLLAVRNDEELGKLLAGVTIAHGGVLPNINPVLLPKKSEKAAAKEPKSPSKATKSPKKA

SEQ ID NO: 26121 - protein, 153 aa, Theobroma cacao
MDAGAKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKNDKAPKEPKSPSKATKSPKKSPKKA

SEQ ID NO: 26122 - protein, 149 aa, Zingiber officinale
MELGGKARKGAGGRRGGGGPKKKPVSRSVKAGLQFPVGRIGRYLKNGRYAKRVGTGAPVYLAAVLEYLAAEVLELAGNAARDNKKNRIIPRHVLLAIRNDEELGKLLAGVTIAHGGVLPNINPVLLPKKAAGKEPKSPAKSAAKSPKKP

SEQ ID NO: 26123 - protein, 149 aa, Zingiber officinale
METGGKARKGAGGRRGGGGPKKKPVSRSVKAGLQFPVGRIGRYLKHGRYAKRVGTGAPVYLAAVLEYLAAEVLELAGNAARDNKKTRIVPRHVLLAIRNDEELGKLLAGVTIAHGGVLPNINPVLLPKKTASKEPKSPSKPAGKSPKKA

SEQ ID NO: 26124 - protein, 153 aa, Cucumis sativus
  Sequence also found in Organisms: Cucumis melo, Citrullus lanatus
METGGKLKKGAGGRKGGGPKKKPVSRSVKAGLQFPVGRIGRYLKNGRYARRVGTGAPVYLAAVLEYLAAEVLELAGNAARDNKKNRIIPRHVLLAIRNDEELGKLLAGVTIAHGGVLPNINPVLLPKKSEKATTKEPKSPSKAPKATKSPKKA

SEQ ID NO: 26125 - protein, 153 aa, Eschscholzia californica
MDTGKVKKGAGGRKGGGPKKKSVSRSVKAGLQFPVGRIGRYLKKGRYSQRVGSGAPVYLAAVLEYLAAEVLELAGNAARDNKKNRIIPRHVLLAVRNDEELGKLLAGVTIAHGGVLPNINPILLPKKSEKAAEKAATKTPKSPSKATKSPKKA

SEQ ID NO: 26126 - protein, 154 aa, Gossypium hirsutum
  Sequence also found in Organisms: Gossypium raimondii
MDAGSKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKNEKAAAKEPKSPSKATKSPKKSPKKA

SEQ ID NO: 26127 - protein, 148 aa, Actinidia deliciosa
METGGKMKKGAAGRRGGGPKKKPITRSVKAGLQFPVGRIGRYLKKGRYAQRVGSGAPVYLAAVLEYLAAEVLELAGNAARDNKKNRIIPRHVLLAVRNDEELGKLLAGVTIAHGGVLPNINPVLLPKKTQATKEPKSPTKATKSPKKA

SEQ ID NO: 26128 - protein, 148 aa, Solanum melongena
MESTGKVKKGAGGRKGGGPKKKPVTRSVKAGLQFPVGRIGRYLKKGQYAQRVGSGAPVYLAAVLEYLAAEVLELAGNAARDNKKNRIIPRHLLLAVRNDEELGKLLAGVTIAHGGVLPNINPVLLPKKTGAEKAPKSPSKATKSPKKA

SEQ ID NO: 26129 - protein, 152 aa, Orobanche aegyptiaca
MEASGKVKKGAAGRKIGGGPRKKSVTRSVRAGLQFPVGRIGRYLKKGRYAQRVGTGAPVYVAAVLEYLAAEVLELAGNAARDNKKNRIIPRHLLLAVRNDEELGKLLAGVTIAHGGVIPNINPVLLPKKNEKDGEKTPKSPAKKATKSPKKA

SEQ ID NO: 26130 - protein, 148 aa, Medicago truncatula
MEASTKTTKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLNGVTIAHGGVLPNINPILLPKKTEKAVSKEPKKAGKSPKKA

SEQ ID NO: 26131 - protein, 210 aa, Saccharum officinarum
MARLLLLAAAAAAFLAASAASPVASDFIRKSCRATQYPSVCEQSLASYGGSPPPRSPRELARAALSVSADRARAASAYVGRLCGGSGSGGSRGAGAKGAKKGSGSAASAAGPVRDCLENLADSVGHLRDAAQEMGGAGMSRAGTPAFKWHLSNVQTWCSAALTDENTCLDGLSARGVDAGTRAAIRGKVVEVAQVTSNALALVNKVGPGY

SEQ ID NO: 26132 - protein, 279 aa, Capsicum annuum
MAKDIEVGTEYAPKDYQDPPPAPLIDPEELGKWSFYRAIIAEFIATLLFLYITVLTVIGYKSQSATDQCGGVGILGIAWAFGGMIFVLVYCTAGISGGHINPAVTFGLFLARKVSLVRAIMYIVAQCLGAICGCGLVKAFQKAYYFRYGGGANTLNDGYSTGTGLGAEIIGTFVLVYTVFAATDPKRNARDSHVPVLAPLPIGFAVFMVHLATIPVTGTGINPARSFGAAVIYGKDKAWDDQWIFWVGPFIGAAIAAFYHQFILRAGAVKALGSFRSNA

SEQ ID NO: 26133 - protein, 279 aa, Solanum tuberosum
MAKDIEVATEYAPKDYQDPPPAPLIDPEELGKWSFYRAIIAEFIATLLFLYITVLTVIGYKSQSSTDQCGGVGILGIAWAFGGMIFVLVYCTAGISGGHINPAVTFGLFLARKVSLVRAIMYIVAQCLGAICGCGLVKSFQNAYYVQYGGGANTLSDGYSTGTGLGAEIIGTFVLVYTVFAATDPKRNARDSHVPVLAPLPIGFAVFMVHLATIPVTGTGINPARSFGAAVIYGDDKAWNDQWIFWVGPFIGAAIAAFYHQFILRAGAVKALGSFRSNA

SEQ ID NO: 26134 - protein, 283 aa, Nicotiana tabacum
MAKDTEVGTEYAPKDYQDPPPAPLIDPEELGKWSFYRAIIAEFIATLLFLYITVLTVIGYKSQIDPDHNGEQCGGVGILGIAWAFGGMIFVLVYCTAGISGGHINPAVTFGLFLARKVSLVRAIMYMLAQCLGAICGCGLVKAFQKAYYVKYGGGANTLNDGYNTGTGLGAEIIGTFVLVYTVFAATDPKRNARDSHVPVLAPLPIGFAVFMVHLATIPVTGTGINPARSFGAAVIYGKEKAWDDQWIFWVGPFIGAAIAAFYHQFILRAGAVKALGSFRSNA

SEQ ID NO: 26135 - protein, 285 aa, Ipomoea nil
MAKDVEGATEYAAPKDYQDPPPAPLIDPEELGKWSFYRAIIAEFIATLLFLYVTVLTVIGYKSQTDPNVKGTDECGGVGILGIAWAFGGMIFILVYCTAGISGGHINPAVTFGLFLARKVSLVRAVMYMVAQCLGAICGCGLVKAFQKAYYVRYGGGANGLQDGYSKGTGLGAEIIGTFVLVYTVFAATDPKRNARDSHVPVLAPLPIGFAVFMVHLATIPITGTGINPARSFGAAVIYGKDKAWDDQWIFWVGPFVGAAIAAVYHQYVLRAGAAKALGSYRSNA

SEQ ID NO: 26136 - protein, 284 aa, Actinidia deliciosa
MAKDIEVGGNEYAAKDYQDPPPAPLVDAEELTQWSFYRAIIAEFIATLLFLYITVLTVIGYKSQTDPDKNSDACGGVGILGIAWAFGGMIFVLVYCTAGISGGHINPAVTFGLFLARKVSLVRAIMYTVAQSLGAICGCALVKAFQEAHYVKYGGGANGLSAGYSTGTGLAAEIIGTFVLVYTVFSATDPKRNARDSHVPVLAPLPIGFAVFMVHLATIPITGTGINPARSFGAAVIYGKDKAWDDQWIFWVGPFIGAAIAAFYHQYILRAGAVKALGSFRSSA

SEQ ID NO: 26137 - protein, 281 aa, Antirrhinum majus
MAKDAEAGTEYGAKDYHDPPPAPLFDPEELGKWSFYRAIIAEFVATLLFLYITVLTVIGYKSQSATDECGGVGILGIAWAFGGMIFVLVYCTAGISGGHINPAVTFGLFLARKVSLVRTILYIVAQCLGAICGCGLVKAFQKSYYNRYGGGANSLADGYSTGTGLAAEIIGTFVLVYTVFSATDPKRSARDSHVPVLAPLPIGFAVFMVHLATIPITGTGINPARSFGAAVIFGSEKSWDDHWIFWVGPLIGAAIAAIYHQYILRAGAIKALGSFKSTPNY

SEQ ID NO: 26138 - protein, 283 aa, Ricinus communis
MVKDMEVGERGPFSAKDYHDPPPAPLIDAVELTKWSFYRALIAEFIATLLFLYITVLTVIGYKSQSESDSCGGVGILGIAWAFGGMIFILVYCTAGISGGHINPAVTFGLFLARKVSLVRAIMYMVAQCLGAICGVGLVKAFQSSHYKRYGGGANTLDDNYSTGVGLGAEIIGTFVLVYTVFSATDPKRSARDSHVPVLAPLPIGFAVFMVHLATIPITGTGINPARSLGAAVIYNQDKAWDDQWIFWVGPFIGAAIAAFYHQFILRAGAVKALGSFRSNPTV

SEQ ID NO: 26139 - protein, 285 aa, Phaseolus vulgaris
MAKHDAEGGSFSAKDYHDPPPAPLIDAQELTQWSFYRALIAEFIATLLFLYITVLTVIGYKSQSDVKAGGDLCGGVGILGIAWAFGGMIFILVYCTAGISGGHINPAVTFGLFLARKVSLIRAIMYMVAQCLGAICGVGLVKAFQKAYYNKYGGGANELSDGYSTGVGLGAEIIGTFVLVYTVFSATDPKRNARDSHVPVLAPLPIGFAVFMVHLATIPVTGTGINPARSLGAAVIYNKEKAWDDQWIFWVGPFIGAAIAAFYHQFILRAGAAKALGSFRSNPTV

SEQ ID NO: 26140 - protein, 284 aa, Glycine max
MAKDVEVAERGSFSGKDYQDPPPAPLIDAEELTKWSFYRALIAEFIATLLFLYITVLTVIGYKHQTDHADACGGVGILGIAWAFGGMIFILVYCTAGISGGHINPAVTFGLFLARKVSLIRAIMYMVAQCLGAICGVGLVKAFQKSYFNKYGGGANSLADGYSTGTGLGAEIIGTFVLVYTVFSATDPKRNARDSHVPVLAPLPIGFAVFMVHLATIPVTGTGINPARSLGAAVIYNQDKPWDDHWIFWVGPFIGAAIAAFYHQFILRAGAAKALGSFRSNPHN

SEQ ID NO: 26141 - protein, 287 aa, Phaseolus vulgaris
MAKDVEVTERGSFSGKDYHDPPPAPLIDTEELTKWSFYRALIAEFIATLLFLYITVLTVIGYKHQSDLKDHGDACGGVGILGIAWAFGGMIFILVYCTAGISGGHINPAVTFGLFLARKVSLIRAIMYMVAQCLGAICGVGLVKAFQKSYYNRYGGGANSLADGYSTGTGLGAEIIGTFVLVYTVFSATDPKRNARDSHVPVLAPLPIGFAVFMVHLATIPVTGTGINPARSLGAAVIYNKDKPWDDHWIFWVGPFIGAAIAAFYHQFILRAGAVKALGSFRSNPHV

SEQ ID NO: 26142 - protein, 287 aa, Vigna unguiculata
MAKDVEVTERGSFSGKDYHDPPPAPLIDAEELTKWSFYRALIAEFIATLLFLYITVLTVIGYKHQSDVKANGDICGGVGILGIAWAFGGMIFILVYCTAGISGGHINPAVTFGLFLARKVSLIRAIMYMVAQCLGAICGVGLVKAFQKSYYNKYGGGANSLADGYSTGTGLGAEIIGTFVLVYTVFSATDPKRNARDSHVPVLAPLPIGFAVFMVHLATIPVTGTGINPARSLGAAVIYNKDKPWDDHWIFWVGPFIGAAIAAFYHQFILRAGAAKALGSFRSNPHV

SEQ ID NO: 26143 - protein, 285 aa, Populus trichocarpa
MAKDTEVAEAGSFSAKDYQDPPPAPLIDAEELTKWSFYRALIAEFIATMLFLYITVLTVIGYKSQIDGNADPCGGVGILGIAWAFGGMIFVLVYCTAGISGGHINPAVTFGLFLARKVSLIRAVMYMVAQCAGAICGVGLVKAFQKSYYTKYNGGANVLADGYSTGTGLGAEIIGTFVLVYTVFSATDPKRSARDSHVPVLAPLPIGFAVFMVHLATIPITGTGINPARSFGAAVIYNKKKAWDDQWIFWVGPFIGAAIAAFYHQFILRAGAIKALGSFRSNPNV

SEQ ID NO: 26144 - protein, 284 aa, Carthamus tinctorius
MGKDVEVGGHDYGAKDYQDPPPAKLFDAEELTKWSFYRAIIAEFVATLLFLYITVLTVIGYKSQTDPIHSPDQCGGVGILGIAWAFGGMIFILVYCTAGISGGHINPAVTFGLFLARKVTLPRAVMYIVAQCLGAICGCGLVKAFQKTYYDDYGGGANELADGYNKGTGLGAEIIGTFVLVYTVFSATDPKRNARDSHVPVLAPLPIGFAVFMVHLATIPITGTGINPARSFGAAVIYGKDKAWDDQWLFWVGPMIGAAIAAIYHQYVLRAGAVKALGSLRSNA

SEQ ID NO: 26145 - protein, 288 aa, Ricinus communis
MGKDVEVGGHGGEFHAKDYHDPPPAPLIDAEELTKWSFYRAIIAEFIATLLFLYITVLTVIGYKSQTDPAKNADACGGVGILGIAWAFGGMIFILVYCTAGISGGHINPAVTFGLFLARKVSLVRAIMYMAAQCLGAICGCGLVKAFQRAYYNRYGGGANELADGYSTGTGLGAEIIGTFVLVYTVFAATDPKRNARDSHVPVLAPLPIGFAVFMVHLATIPVTGTGINPARSFGAAVIYNKEKAWDDQWIFWVGPFIGAAIAAIYHQYVLRASAAKALGSFRSSSNI

SEQ ID NO: 26146 - protein, 281 aa, Fragaria vesca
MAKDVEGAEHGEFAAKDYHDPPPTPLFDADELTKWSFYRAVIAEFIATLLFLYITVLTVIGYKSQSATDQCGGVGILGIAWAFGGMIFVLVYCTAGISGGHINPAVTFGLFLARKVSLLRAVLYIVAQSLGAICGVGLVKAFQKTLYDEYGGGANTLAPGYSKGTGLAAEIIGTFVLVYTVFSATDPKRNARDSHVPVLAPLPIGFAVFMVHLATIPITGTGINPARSFGAAVIYNQDKAWDDHWMFWLGPFIGAAIAAFYHQFVLRAGAIKALGSFRSNA

SEQ ID NO: 26147 - protein, 287 aa, Arachis hypogaea
MAKDVEVAERGSFSGKDYQDPPPAPLIDAEELTKWSFYRALIAEFIATLLFLYITVLTVIGYKSQTDTTANGDVCGGVGILGIAWAFGGMIFILVYCTAGISGGHINPAVTFGLFLARKVSLIRAILYMVAQCLGAICGVGLVKAFQKSLYTRYGGGANSLNDGYSTGTGLGAEIIGTFVLVYTVFSATDPKRSARDSHVPVLAPLPIGFAVFMVHLATIPVTGTGINPARSFGAAVIFNQDKPWDDHWIFWVGPFIGAAIAAFYHQFILRAGAVKALGSFRSNPNV

SEQ ID NO: 26148 - protein, 285 aa, Glycine max
MAKHDVEGGSFSAKDYHDPPPAPLIDAEELTQWSFYRALIAEFIATLLFLYITVLTVIGYKSQSDVKAGGDVCGGVGILGIAWAFGGMIFILVYCTAGISGGHINPAVTFGLFLARKVSLIRAIMYMVAQCLGAICGVGLVKAFQKAYYNRYGGGANELSEGYSTGVGLGAEIIGTFVLVYTVFSATDPKRNARDSHVPVLAPLPIGFAVFMVHLATIPVTGTGINPARSLGAAVMYNQQKAWDDHWIFWVGPFIGAAIAAFYHQFILRAGAAKALGSFRSNPTI

SEQ ID NO: 26149 - protein, 284 aa, Fragaria vesca
MAKDIEVGGFAAKDYHDPPPTPLIDPEEFGKWSFYRAIIAEFIATLLFLYITVLTVIGYKSQSDTLKGGDQCGGVGILGIAWAFGGMIFVLVYCTAGISGGHINPAVTFGLFLARKVSLPRAVMYIVAQSLGAICGCALVKSFQSALYTNYGGGANGLADGYNKGTGLAAEIIGTFVLVYTVFSATDPKRNARDSHVPVLAPLPIGFAVFMVHLATIPITGTGINPARSLGAAVIYNNEKAWDDHWIFWVGPFIGAAIAAMYHQYILRAGAVKALGSFRSSSNI

SEQ ID NO: 26150 - protein, 288 aa, Manihot esculenta
MAKDVEVGGQGSGFQAKDYSDPPPAPLIDAEEFTQWSFYRAIIAEFIATLLFLYITVLTVIGYKSQTDPAKNADACGGVGILGIAWAFGGMIFILVYCTAGISGGHINPAVTFGLFLARKVSLVRAILYMAAQCLGAICGCGLVKAFQKAYYTRYGGGANELADGYSKGTGLGAEIIGTFVLVYTVFSATDPKRNARDSHVPVLAPLPIGFAVFMVHLATIPVTGTGINPARSFGAAVIYNQDKAWDDQWIFWVGPFIGAAIAALYHQYILRAGAVKALGSFRSTSNI

SEQ ID NO: 26151 - protein, 285 aa, Glycine max
MAKHDVEGGSFSAKDYHDPPPAPLIDAEELTQWSFYRALIAEFIATMLFLYITVLTVIGYKSQSDVKAGGDVCGGVGILGIAWAFGGMIFILVYCTAGISGGHINPAVTFGLFLARKVSLIRAIMYMVAQCLGAICGVGLVKAFQKAYYNRYGGGANELSEGYSTGVGLGAEIIGTFVLVYTVFSATDPKRNARDSHVPVLAPLPIGFAVFMVHLATIPVTGTGINPARSLGAAVMYNQQKAWDDHWIFWVGPFIGAAIAAFYHQFILRAGAAKALGSFRSNPAI

SEQ ID NO: 26152 - protein, 285 aa, Vigna unguiculata
MAKHDVEGGSFSAKDYHDPPPAPLIDGEELTQWSFYRALIAEFIATLLFLYITVLTVIGYKSQSDVKAGGDLCGGVGILGIAWAFGGMIFILVYCTAGISGGHINPAVTFGLFLARKVSLIRAIMYMVAQCLGAICGVGLVKAFQKGYYNRYGGGANELSEGYSTGVGLGAEIIGTFVLVYTVFSATDPKRNARDSHVPVLAPLPIGFAVFMVHLATIPVTGTGINPARSFGAAVIYNKEKAWDDHWMFWVGPFIGAAIAAFYHQFILRAGAAKALGSFRSNPTI

SEQ ID NO: 26153 - protein, 285 aa, Gossypium hirsutum
  Sequence also found in Organisms: Gossypium raimondii
MAKDVEVGGEFQAKDYHDPPPAPLVDGEELTKWSFYRAVIAEFIATLLFLYITVLTVIGYKSQVDPDKGSDECGGVGILGIAWAFGGMIFILVYCTAGISGGHINPAVTFGLFLARKVSLVRAIFYMAAQCLGAICGCGLVKAFQKSYYNKYGGGANSLADGYSTGTGLAAEIIGTFVLVYTVFSATDPKRNARDSHIPVLAPLPIGFAVFMVHLATIPITGTGINPARSFGAAVIYNQDKPWDDHWIFWVGPFIGAAIAAIYHQFILRAAAVKALGSFRSSSAM

SEQ ID NO: 26154 - protein, 287 aa, Ricinus communis
MAKDVEVAEATGGEFSAKDYHDPPPAPLIDVDELGKWSFYRALIAEFIATLLFLYITVLTVIGYKSQTDPDKNADACGGVGILGIAWAFGGMIFILVYCTAGISGGHINPAVTFGLFLGRKVSLIRALGYMVAQCLGAICGCGLVKAFQKAYYNRYGGGANELADGYNKGTGLGAEIIGTFVLVYTVFSATDPKRSARDSHVPVLAPLPIGFAVFMVHLATIPITGTGINPARSFGAAVIYNKEKAWDDQWIFWVGPFIGAAIAAFYHQYILRAAAIKALGSFRSNA

SEQ ID NO: 26155 - protein, 284 aa, Populus trichocarpa
MAKDIEVAEHGETVKDYQDPPPAPLIDAEELGQWSFYRALIAEFIATLLFLYVTVLTVIGYKSQTDPDKGLDACGGVGILGIAWAFGGMIFVLVYCTAGISGGHINPAVTFGLFLARKVSLIRAVLYMVAQCLGAICGCGLVKAFQKSYYNHYGGGANELQEGYNKGTGLGAEIIGTFVLVYTVFSATDPKRNARDSHVPVLAPLPIGFAVFMVHLATIPITGTGINPARSFGAAVIFNQSKAWDDHWLFWVGPFIGAAIAAFYHQFILRAAAIKALGSFRSNA

SEQ ID NO: 26156 - protein, 285 aa, Fragaria vesca
MAKDVEVAERGSFSAKDYQDPPPAPLFDSVELTKWSFYRAVIAEFIATLLFLYITVLTVIGYKSQIDLGGDACGGVGILGIAWAFGGMIFILVYCTAGISGGHINPAVTFGLFLARKVSLVRAVMYIVAQSLGAIAGVGLVKAFQKSYYTKYGGGANELAEGYSTGVGLAAEIIGTFVLVYTVFSATDPKRSARDSHVPVLAPLPIGFAVFMVHLATIPITGTGINPARSLGAAVIYDKKKAWDDQWIFWVGPFIGAAIAAFYHQFILRAGAVKALGSFRSNPHN

SEQ ID NO: 26157 - protein, 283 aa, Helianthus annuus
MTKDVEVAEHHGGKDYHDPPPAPLIDGEELTKWSFYRALIAEFIATLLFLYVTVLTVIGYKVQTDPKLDTDQCGGVGILGIAWAFGGMIFVLVYCTAGISGGHINPAVTFGLFLARKVSLIRALGYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAAAAAFYHQFVLRAGAIKALGSFRSNA

SEQ ID NO: 26158 - protein, 287 aa, Arachis hypogaea
MTKDLEVTERGSFSGKDYHDPPPAPLIDAEELTKWSFYRALIAEFIATLLFLYITVLTVIGYKSQSDPKAGGDMCGGVGILGIAWAFGGMIFILVYCTAGISGGHINPAVTFGLFLARKVSLIRAILYMVAQCLGAICGVGLVKAFQTSLYVRYGGGANSLADGYSKGTGLGAEIIGTFVLVYTVFSATDPKRNARDSHVPVLAPLPIGFAVFMVHLATIPVTGTGINPARSLGAAVIYNKSKPWDDHWIFWVGPFIGAAIAAFYHQFILRAGAAKALGSFRSNPNV

SEQ ID NO: 26159 - protein, 280 aa, Vitis vinifera
MTKDVETSGQEFSNKDYHDPPPAPLIDPDELTQWSLYRAIIAEFIATLLFLYITVLTVIGYKSQSDTDPCGGVGILGIAWAFGGMIFILVYCTAGISGGHINPAVTFGLFLARKVSLVRALMYMIAQCLGAVCGVGLVKAFQSSLYNRYGGGANELAGGYNKGVGLGAEIIGTFVLVYTVFSATDPKRNARDSHVPVLAPLPIGFAVFMVHLATIPITGTGINPARSFGAAVIYNNDKAWDDHWMFWVGPFIGAAIAAFYHQYILRAAAIKALGSFRSNA

SEQ ID NO: 26160 - protein, 284 aa, Juglans hindsii x Juglans regia
MGKDVEGAEQGEYSAKDYQDPPPAPLIDPEELTKWSFYRALIAEFIATLLFLYITVLTVIGYKVQSSAPDADDCAGVGILGIAWAFGGMIFILVYCTAGISGGHINPAVTFGLFLARKVSLIRAVLYMVAQCLGAICGVGLVKGFQKTHYNQNGGGANELAPGYNKGVGLGAEIIGTFVLVYTVFSATDPKRSARDSHVPVLAPLPIGFAVFMVHLATIPITGTGINPARSFGAAVIYNQDKAWDDQWIFWVGPFIGAAIAAFYHQFILRAGAIKALGSFRSNA

SEQ ID NO: 26161 - protein, 283 aa, Lactuca sativa
MTKDVEVAEHHGGKDYHDPPPAPLIDAEELTKWSFYRAVIAEFIATLLFLYVTVLTVIGYKSQTDPALDLDQCGGVGILGIAWAFGGMIFILVYCTAGISGGHINPAVTFGLFLARKVSLIRAVLYMIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAAIAAFYHQFVLRAGAIKALGSFRSNA

SEQ ID NO: 26162 - protein, 283 aa, Actinidia deliciosa
MGKDTEMTEQGSFSAKDYQDPPPAPLIDPKELGKWSFYRALIAEFIATLLFLYITVLTVIGYKSNKSADPCDGVGILGIAWAFGGMIFVLVYCTAGISGGHINPAVTFGLFLARKVSLIRAVMYMVAQCLGAICGVGLVKAFQNSYYDNNGGGANMLASGYNKGTGLGAEIIGTFVLVYTVFSATDPKRSARDSHVPVLAPLPIGFAVFMVHLATIPVTGTGINPARSFGAAVIYNKSKAWDDHWIFWVGPFLGAAIAAFYHQFILRAGAIKALGSFRSSSHV

SEQ ID NO: 26163 - protein, 287 aa, Glycine max
MAKDVEVAERGSFSGKDYQDPPPAPLIDAEELTKWSFYRALIAEFIATLLFLYITVLTVIGYNHQTDLKENGEICGGVGILGIAWAFGGMIFILVYCTAGISGGHINPAVTFGLFLARKVSLIRAIMYMVAQCLGAICGVGLVKAFQKSYFNKYGGGANSLAAGYSTGTGLGAEIIGTFVLVYTVFSATDPKRNARDSHVPVLAPLPIGFAVFMVHLATIPVTGTGINPARSLGAAVIYNQDKPWDDHWIFWVGPFIGAAIAAFYHQFILRAGAAKALGSFRSNPHN

SEQ ID NO: 26164 - protein, 287 aa, Juglans hindsii x Juglans regia
MAKDIEAAGQGGFSAKDYHDPPPAPLIDAEEFTQWSFYRAIIAEFIATLLFLYITVLTVIGYKSQTDKAKGGDDCGGVGILGIAWAFGGMIFVLVYCTAGISGGHINPAVTFGLFLARKVSLVRAVFYMAAQCLGAVCGCGLVKAFQKAYYSKYGGGANELADGYSKGTGLAAEIIGTFVLVYTVFSATDPKRNARDSHVPVLAPLPIGFAVFMVHLATIPITGTGINPARSFGAAVIYGKDKAWNDQWIFWVGPFIGAAIAAFYHQYILRAGAAKALGSFRSSSTI

SEQ ID NO: 26165 - protein, 285 aa, Lactuca sativa
MTKDVQEQGSFSAKDYHDPPPAPLIDPGELTKWSFYRALIAEFIATLLFLYITVLTVIGYKSQTDPALNLDQCGGVGILGIAWAFGGMIFVLVYCTAGISGGHINPAVTFGLFLARKVSLIRAIMYMVAQCLGAICGVGLVKAFHKSYYMRYGGGANELADGYNKGTGLGAEIIGTFVLVYTVFSATDPKRSARDSHVPVLAPLPIGFAVFMVHLATIPITGTGINPARSLGAAVIYNKAKAWDDQWIFWVGPFIGAAIAAFYHQFILRAGAIKALGSFRSTTNN

SEQ ID NO: 26166 - protein, 285 aa, Populus trichocarpa
MGKDIEVGGEFSAKDYHDPPPAPLIDAEEITQWSFYRAIIAEFVATLLFLYITVLTVIGYKSQTDVNKNGDECGGVGILGIAWAFGGMIFILVYCTAGISGGHINPAVTFGLFLARKVSLVRAILYMVAQCLGAICGCGLVKAFQKSYYTNYGGGANGLANGYSKGTGLGAEIIGTFVLVYTVFSATDPKRNARDSHVPVLAPLPIGFAVFMVHLATIPITGTGINPARSFGAAVIFNKEKAWDDHWIFWVGPFIGAAIAALYHQFILRAAAVKSLGSFRSSPNI

SEQ ID NO: 26167 - protein, 285 aa, Gossypium hirsutum
  Sequence also found in Organisms: Gossypium raimondii
MAKDVEVGGEFQAKDYHDPPPAPLVDAQELTQWSFYRAIIAEFIATLLFLYITVLTVIGYKSQVDPDKGGQDCDGVGILGIAWAFGGMIFILVYCTAGISGGHINPAVTFGLFLARKVSLVRAILYMAAQCLGAICGCGLVKAFQKSYYNKYGGGANSLADGYSTGTGLAAEIIGTFVLVYTVFSATDPKRNARDSHVPVLAPLPIGFAVFMVHLATIPITGTGINPARSFGAAVMFNQDKPWDDHWIFWVGPFIGAAIAAIYHQYILRAGAAKALGSFRSSSAM

SEQ ID NO: 26168 - protein, 283 aa, Cucumis melo
MGKDVEVAEQGEFQSKDYQDPPPAPLIDPEELTKWSLYRAAIAEFIATLLFLYVTVLTVIGYSHQRDSTPDPCSGVGILGIAWAFGGMIFILVYCTAGISGGHINPAVTFGLFLARKVSLVRAVLYMLAQCAGAICGCGLVKAFQSAYYVRYNGGANMLSDGYNKGTGLGAEIIGTFVLVYTVFSATDPKRNARDSHVPVLAPLPIGFAVFMVHLATIPITGTGINPARSFGAAVIFNKEKAWDDQWIFWVGPFIGAAIAAIYHQYVLRAGAIKALGSFRSNA

SEQ ID NO: 26169 - protein, 287 aa, Mesembryanthemum crystallinum
MTKDVEVAEQQAPEFSAKDYHDPPPAPLIDFEELRKWSFYRAVIAEFIATLLFLYITVLTVIGYKSQTDPNTNADQCGGVGILGIAWAFGGMIFILVYCTAGISGGHINPAVTFGLFLARKVSLIKAVLYMVAQCLGAICGVGFVKAFQKAYYVRYGGGANEMASGYTKGTGLGAEIIGTFVLVYTVFAATDPKRNARDSHVPVLAPLPIGFAVFMVHLATIPITGTGINPARSFGAAVIYNQQKAWDDHWIFWVGPFIGAAIAAFYHQYILRAAAIKALGSFRSSA

SEQ ID NO: 26170 - protein, 281 aa, Carica papaya
MTKDAGEHGSFSAKDYHDPPPAPLFDAVELTKWSFYRALIAEFIATLLFLYVTVLTVIGHKSQHAADQCGGVGILGIAWAFGGMIFILVYCTAGISGGHINPAVTFGLFLARKVSLVRAVMYMVAQCLGAICGVGLVKAFQKSFYNRFGGGANTLADGYNVGTGLGAEIIGTFVLVYTVFSATDPKRSARDSHVPVLAPLPIGFAVFMVHLATIPVTGTGINPARSFGAAVIFNDKKAWDDHWIFWVGPFIGAAIAAFYHQFILRAAAVKALGSFRSQSHV

SEQ ID NO: 26171 - protein, 285 aa, Helianthus annuus
MTKDVPEQGSFSAKDYHDPPPAPFIDPEELTKWSFYRALIAEFIATLLFLYITVLTVIGYKSTTDPKLNADQCGGVGILGIAWAFGGMIFVLVYCTAGISGGHINPAVTFGLFLARKVSLIRAVMYMVAQCLGAICGVGLVKAFNKSLYNRYGGGANELADGYNTGTGLGAEIIGTFVLVYTVFSATDPKRSARDSHVPVLAPLPIGFAVFMVHLATIPITGTGINPARSLGAAVIYNKDKAWDDQWIFWVGPFVGAAIAAFYHQFILRAGAVKALGSFRSSTHV

SEQ ID NO: 26172 - protein, 283 aa, Lactuca sativa
MTKDVAEEGSFSAKDYHDPPPAKFIDPKELTRWAFYRALIAEFVATLLFLYITVLTVIGYKSQIDKGSDACGGVGILGIAWAFGGMIFVLVYCTAGISGGHINPAVTFGLFLARKVSLPRAIMYMVAQCLGAICGVGLVKAFHKTYYTNYGGGANELADGYSKGTGLGAEIIGTFVLVYTVFSATDPKRSARDSHVPVLAPLPIGFAVFMVHLATIPITGTGINPARSFGAAVIYNKEKAWDDQWIFWVGPFIGAAIAAFYHQFILRAGAAKALGSFRSSGHV

SEQ ID NO: 26173 - protein, 289 aa, Citrus clementina
  Sequence also found in Organisms: Citrus sinensis
MGKDVEVAEQQGGGGEFSAKDYHDPPPAPLIDFEELGKWSFYRAVIAEFIATLLFLYVTVLTVIGYKSQTDPNLNTDQCGGVGILGIAWAFGGMIFILVYCTAGISGGHINPAVTFGLFLGRKVSLIRALLYMVAQCLGAICGCGFVKAFQKSYYNRYGGGANELADGYNKGTGLGAEIIGTFVLVYTVFSATDPKRSARDSHVPVLAPLPIGFAVFMVHLATIPITGTGINPARSFGAAVIYNKEKAWDDQWIFWVGPFIGAFVAAFYHQYILRAAAIKALGSFRSNA

SEQ ID NO: 26174 - protein, 286 aa, Euphorbia peplus
  Sequence also found in Organisms: Euphorbia esula
MGKDVEVAEPAAEFSAKDYHDPPPAPLFDMGELGKWSFYRAVIAEFIATLLFLYITVLTVIGYKSQTDPNLNKDACGGVGILGIAWSFGGMIFILVYCTAGISGGHINPAVTFGLFLGRKVSLIRAVMYMIAQCLGAICGCGLVKAFQKSYYHRYGGGANELSSGYSKGTGLGAEIIGTFVLVYTVFSATDPKRSARDSHVPVLAPLPIGFAVFMVHLATIPITGTGINPARSFGAAVIYNEDKAWDDQWIFWVGPFIGAAVAAFYHQFVLRAAAIKALGSFRSNA

SEQ ID NO: 26175 - protein, 282 aa, Gossypium hirsutum
MAKEGENSTFHARDYVDPPPAPLIDASELKKWSFYRALIAEFIATMLFLYITVLTVIGHKSQVATSPDACSGVGLLGIAWAFGGMIFILVYCTAGISGGHINPAVTFGLFLARKVSLIRAIAYMVAQSLGAICGVGLVKAFQSAYYNRYGGGANTLADGYSTGTGLGAEIIGTFVLVYTVFSATDPKRKARDSHVPVLAPLPIGFAVFMVHLATIPITGTGINPARSIGAAVIFNNKKAWDDHWIFWVGPMIGAAIAAFYHQFILRAGAAKALGSFRSQTHV

SEQ ID NO: 26176 - protein, 287 aa, Medicago truncatula
MAKDVEVAERGSFSNKDYHDPPPAPLIDAEELTKWSFYRALIAEFIATLLFLYVTVLTVIGYSIQTDVKAGGDACGGVGILGIAWAFGGMIFVLVYCTAGISGGHINPAVTFGLFLARKVSLIRAIMYMVAQCLGAIAGVGLVKAFQSAYFDRYGGGANFLHDGYSTGVGLGAEIVGTFVLVYTVFSATDPKRSARDSHVPVLAPLPIGFAVFMVHLATIPVTGTGINPARSLGSAVIYNKDKPWDDHWIFWVGPFIGAAIAAFYHQFILRAGAVKALGSFRSNPTV

SEQ ID NO: 26177 - protein, 287 aa, Actinidia deliciosa
MGKDMEVAEQGSFSAKDYHDPPPAPLVDPAELGKWSFYRALIAEFIATLLFLYITVLTVIGYKSQTDPAINADACGGVGILGIAWAFGGMIFVLVYCTAGISGGHINPAVTFGLFLARKVSLIRAVMYMVAQCLGAICGVGLVKTFQNSYYDRYGGGANELAAGYSTGTGLGAEIIGTFVLVYTVFSATDPKRSARDSHVPVLAPLPIGFAVFMVHLATIPVTGTGINPARSLGAAVIYNQKKAWDDQWIFWVGPFVGAALAAFYHQFVLRAAAAKALGSFRSSSHV

SEQ ID NO: 26178 - protein, 289 aa, Gossypium hirsutum
MTKDIETAEQHGGEFSAKDYHDPPPAPLIDAEELTKWSFYRAVIAEFIATLLFLYVTVLTVIGYKVQTDPAKNTVDPDCGGVGILGIAWAFGGMIFILVYCTAGISGGHINPAVTFGLFVGRKVSLIRALMYMVAQCLGAICGCGLVKAFQKTYYNNYGGGANELQPGFNKGTGLGAEIIGTFVLVYTVFAATDPKRNARDSHVPVLAPLPIGFAVFMVHLATIPVTGTGINPARSFGAAVIYNKEKAWDDQWIFWVGPFIGAAAAAFYHQYILRAAAIKALGSFRSNA

SEQ ID NO: 26179 - protein, 283 aa, Taraxacum officinale
MTKDVEVAEHHGGKDYHDPPPAPFFDAGELTKWSFYRAVIAEFVATLLFLYVTVLTVIGYKSQTDPALNLDECGGVGILGIAWAFGGMIFILVYCTAGISGGHINPAVTFGLFLARKVSLIRAVLYMIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNAKAWDDQWIFWVGPFIGAAIAAFYHQFVLRAGAIKALGSFRSNA

SEQ ID NO: 26180 - protein, 289 aa, Gossypium hirsutum
  Sequence also found in Organisms: Gossypium raimondii
MTKDIETAEQRGGEFSAKDYHDPPPAPLIDAEELTKWSFYRAVIAEFIATLLFLYVTVLTVIGYKVQTDPAKNTVDPDCGGVGILGIAWAFGGMIFILVYCTAGISGGHINPAVTFGLFVGRKVSLIRALMYMVAQCLGAICGCGLVKAFQKTYYNNYGGGANELQPGFNKGTGLGAEIIGTFVLVYTVFAATDPKRNARDSHVPVLAPLPIGFAVFMVHLATIPVTGTGINPARSFGAAVIYNKEKAWDDQWIFWVGPFIGAAAAAFYHQYILRAAAIKALGSFRSNA

SEQ ID NO: 26181 - protein, 287 aa, Citrus clementina
  Sequence also found in Organisms: Citrus sinensis
MAKDTGVAEHGSYSAKDYTDPPPEPLFDAVELTKWSFYRALIAEFIATLLFLYVTVLTVIGYKSQTDPAKNVDGCAGVGILGIAWAFGGMIFVLVYCTAGISGGHINPAVTFGLFLARKVSLVRAVMYMVAQCLGAISGVGLVKAFQKSYYTRYGGGANELADGYSTGVGLAAEIIGTFVLVYTVFSATDPKRSARDSHVPVLAPLPIGFAVFMVHLATIPITGTGINPARSLGAAVIYNKDKAWDDQWLFWVGPFIGAAIAAFYHQFILRAGAVKALGSFRSQSRV

SEQ ID NO: 26182 - protein, 287 aa, Prunus persica
MAKDVEVAERGSFSAKDYHDPPPAPLFDAVELTKWSFYRALIAEFIATLLFLYVTVLTVIGYKSQTDTTVNADACGGVGILGIAWAFGGMIFVLVYCTAGISGGHINPAVTFGLFLARKVSLVRAVLYMVAQSLGAIAGVALVKAFQESYYTKYGGGANELSQGYSKGVGLGAEIIGTFVLVYTVFSATDPKRSARDSHVPVLAPLPIGFAVFIVHLATIPITGTGINPARSLGAAVIYNKEKAWDDQWIFWVGPFIGAAIAAFYHQFILRAGAVKALGSFRSNPHV

SEQ ID NO: 26183 - protein, 284 aa, Ipomoea nil
MTKDMAEPGSFSTKDYHDPPPAPLIDAEELTKWSFYRAVIAEFIATLLFLYITVLTVIGYKSETADPKADPCGGVGILGIAWAFGGMIFILVYCTAGISGGHINPAVTFGLFLARKVSLIRAVMYMVAQCLGAICGVGLVKAFQKAYYTRYGGGANQLAHGYSKGVGLSAEIIGTFVLVYTVFSATDPKRSARDSHVPVLAPLPIGFAVFMVHLATIPITGTGINPARSLGAAVIYNKDEAWHNHWIFWVGPFIGAAIAAFYHQFILRAGAAKALGSFRSGSQV

SEQ ID NO: 26184 - protein, 290 aa, Sorghum bicolor
MGKDDVIESGAGGGEFAAKDYTDPPPAPLIDAAELGSWSLYRAVIAEFIATLLFLYITVATVIGYKHQTDATASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPFVGAAIAAFYHQYILRAGAIKALGSFRSNA

SEQ ID NO: 26185 - protein, 290 aa, Saccharum officinarum
MGKDDVIESGAGGGEFAAKDYTDPPPAPLIDAAELGSWSLYRAVIAEFIATLLFLYITVATVIGYKHQTDTTASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKTWDDQWIFWVGPLAGAAIAAFYHQYILRAGAIKALGSFRSNA

SEQ ID NO: 26186 - protein, 283 aa, Raphanus sativus
MAKDVEGAEGVTARDYEDPPPTPFFDAEELTKWSLYRAVIAEFVATLLFLYITVLTVIGYKISSDTKAGGDECGGVGILGIAWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 26187 - protein, 290 aa, Zea mays
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 26188 - protein, 285 aa, Phaseolus vulgaris
MAKDVEVQEQGEYAAKDYQDPPPAPLFDPEELTQWSFYRALIAEFIATLLFLYVTVLTIIGYKRQTDANVGGTECDGVGILGIAWAFGGMIFILVYCTAGISGGHINPAVTFGLFLGRKVSLIRALLYIVAQCAGAICGTGLAKGFQKAYYNRYGGGANSVADGYNKGTALGAEIIGTFVLVYTVFSATDPKRNARDSHVPVLAPLPIGFAVFMVHLATIPVTGTGINPARSFGAAVIYNKEKIWDDQWIFWVGPIIGAAVAAFYHQYILRAAAIKALGSFRSNA

SEQ ID NO: 26189 - protein, 289 aa, Leymus cinereus x Leymus triticoides
MAKDEVMETGGGGDFAAKDYTDPPPAPLIDAAELASWSLYRAVIAEFIATLLFLYITVATVIGYKHQTDAAVNGADAACGGVGVLGIAWAFGGMIFVLVYCTAGISGGHINPAVTFGLFLARKVSLVRALLYMVAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 26190 - protein, 287 aa, Raphanus sativus
MAKDVEAVSGEGFQTRDYQDPPPAPLFDPEELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 26191 - protein, 287 aa, Raphanus sativus
MAKDVEAVSGEGFQTRDYQDPPPAPLFDPEELTKWSFYRAVIAEFVATLLFLYITVLTVIGYKIETDSTAGGVDCGGVGILGIAWAFGGMIFILVYCTAGISGGHINPAVTFGLLLARKVSLVRAILYMVAQCLGAICGVGFVKAFQSAYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 26192 - protein, 285 aa, Gossypium hirsutum
MAKDIEVGGEFQAKDYHDPPPAPLVDAQELAKWSFYRAVIAEFIATLLFLYITVLTVIGYKTQTDPAKGGEDCGGVGILGIAWAFGGMIFILVYCTAGISGGHINPAVTFGLFLARKVSLVRAIFYMGAQCLGAICGCGLVKAFQNSYYNQYGGGANSLAEGYSTGTGLAAEIIGTFVLVYTVFSATDPKRNARDSHIPVLAPLPIGFAVFMVHLATIPITGTGINPARSLGAAVIFNQDKIWDDHWIFWVGPFIGAAIAAIYHQFILRASGAKALGSFRSSSAM

SEQ ID NO: 26193 - protein, 290 aa, Oryza sativa
MGKDEVMESGGAAGEFAAKDYTDPPPAPLIDAAELGSWSLYRAVIAEFIATLLFLYITVATVIGYKHQTDASASGADAACGGVGVLGIAWAFGGMIFILVYCTAGISGGHINPAVTFGLFLARKVSLVRAILYIVAQCLGAICGVGLVKAFQSAYFNRYGGGANTLAAGYSKGTGLAAEIIGTFVLVYTVFSATDPKRNARDSHVPVLAPLPIGFAVFMVHLATIPITGTGINPARSIGAAVIFNNEKAWHNHWIFWVGPFVGAAIAAFYHQYILRAGAIKALGSFRSNA

SEQ ID NO: 26194 - protein, 290 aa, Triticum aestivum
MAKDEVMETGGGGDFAAKDYTDPPPAPLIDAAELASWSLYRAVIAEFIATLLFLYITVATVIGYKHQTDPAVNTAADAACGGVGVLGIAWAFGGMIFVLVYCTAGISGGHINPAVTFGLFLARKVSLVRALLYMVAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 26195 - protein, 283 aa, Brassica napus
  Sequence also found in Organisms: Brassica juncea, Brassica oleracea, Brassica rapa
MAKDVEGAEGVTARDYEDPPPTPFFDAEELTKWSLYRAVIAEFVATLLFLYVTVLTVIGYKISSDTKAGGDDCGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 26196 - protein, 290 aa, Hordeum vulgare
MAKDEVMETGGGGDFAAKDYTDPPPAPLVDAAELASWSLYRAVIAEFIATLLFLYITVATVIGYKHQTDPAVNSAADAACGGVGVLGIAWAFGGMIFVLVYCTAGISGGHINPAVTFGLFLARKVSLVRALLYMVAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 26197 - protein, 283 aa, Nicotiana tabacum
MGKDVEAATEFSAKDYTDPPPAPLIDFEELKQWSFYRAAIAEFIATLLFLYVTVLTVIGYKHQSDVDANGDVCGGVGILGIAWAFGGMIFVLVYCTAGISGGHINPAVTFGLFLARKVSLIRALVYMVAQCLGAICGVGFVKAFQSAYYDRYGGGANVMAAGHTKGVGLAAEIIGTFVLVYTVFSATDPKRSARDSHVPVLAPLPIGFAVFMVHLATIPITGTGINPARSFGAAVIYNQDKAWDEHWIFWVGPFIGAFAAAAYHQYILRAGAVKALGSFRSNA

SEQ ID NO: 26198 - protein, 283 aa, Malus domestica
MAKDMEVAERGSFPAKDYHDPPPAPLFDPAELAKWSFYRALIAEFVATLLFLYVTVLTVIGYKSQTELDNCGGVGTLGIAWAFGGMIFVLVYCTAGISGGHINPAVTFGLCLARKVSPVRAVLYMVAQSLGAIAGVALVKAIQKSYYTKYGGGANSLSDGYSTGVGLAAEIIGTFVLVYTVFSATDPKRSARDSHVPVLAPLPIGFAVFIVHLATIPITGTGINPARSLGPAVIFNQDKAWDDQWIFWVGPFIGAAIAAFYHQFILRAGAAKALGSFRSHPSV

SEQ ID NO: 26199 - protein, 287 aa, Zingiber officinale
MAKDVEGTEQAEYSAKDYTDPPPAPLIDAEELTKWSLYRAVIAEFIATLLFLYVTVLTVIGYKHQSDTQINNPDAECNGVGVLGIAWAFGGMIFILVYCTAGISGGHINPAVTLGLFLARKVSLVRALLYIIAQCLGAICGVGLVKGFQRSFYVRYGGGANELQPGYSKGTGLGAEIIGTFVLVYTVFSATDPKRSARDSHVPVLAPLPIGFAVFMVHLATIPITGTGINPARSFGAAVIYNKDKAWDDQWIFWVGPVIGAAIAAAYHQYILRASGAKALGSFRSNA

SEQ ID NO: 26200 - protein, 287 aa, Brassica napus
MAKDVEAVSGEGFQTRDYQDPPPAPLFDPEELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFVGAAIAAFYHQFVLRASGSKSLGSFRSAANV

SEQ ID NO: 26201 - protein, 285 aa, Brassica juncea
  Sequence also found in Organisms: Brassica rapa
MAKDVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 26202 - protein, 287 aa, Brassica juncea
MAKDVEAVSGEGFQTRDYQDPPPAPLFDPKELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 26203 - protein, 290 aa, Pseudoroegneria spicata
  Sequence also found in Organisms: Triticum aestivum
MAKDEVMETGGGGDFAAKDYTDPPPAPLIDAAELASWSLYRAVIAEFIATLLFLYITVATVIGYKHQTDPAVNAAADAACGGVGVLGIAWAFGGMIFVLVYCTAGISGGHINPAVTFGLFLARKVSLVRALLYMIAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 26204 - protein, 290 aa, Brachypodium distachyon
MAKDEVMESGGGHQDFAAKDYTDPPPAPLIDAAELASWSLYRAVIAEFIATLLFLYITVATVIGYKHQTDVSASGPDAACGGVGILGIAWAFGGMIFVLVYCTAGISGGHINPAVTFGLFLARKVSLVRALLYMIAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIFNKDKAWDDQWIFWVGPMVGAAIAAFYHQYILRAGAIKALGSFRSNA

SEQ ID NO: 26205 - protein, 285 aa, Gossypium hirsutum
MAKDIEVGGEFQAKDYHDPPPAPLVDAQELAKWSFYRAVIAEFIATLLFLYITVLTVIGYKTQTDLAKGGEDCGGVGILGIAWAFGGMIFILVYCTAGISGGHINPAVTFGLFLARKVSLVRAIFYMGAQCLGAICGCGLVKAFQNSYYNQYGGGANSLAEGYSTGTGLAAEIIGTFVLVYTVFSATDPKRNARDSHIPVLAPLPIGFAVFMVHLATIPITGTGINPARSLGAAVIFNQDKIWDDHWIFWVGPFIGAAIAAIYHQFVLRASGAKALGSFRSSSAM

SEQ ID NO: 26206 - protein, 291 aa, Mesembryanthemum crystallinum
MAKDFETGGGEVRDVAKDYQDPPPSPLFDMEELTKWSFYRALIAEFIATLLFLYITVLTVIGYKHQSDPLVSGADAGCGGVGILGIAWAFGGMIFILVYCTAGISGGHINPAVTFGLFLARKLSLIRAIMYMVAQCLGAICGVGFVKAFQSAYYNKYGGGANELSVGYSKGTGLAAEIIGTFVLVYTVFSATDPKRSARDSHVPVLAPLPIGFAVFMVHLATIPITGTGINPARSLGAAVIYNNNKAWDDQWIFWVGPFIGAAIAAIYHQYILRAGFIKALGSFRSSTSNV

SEQ ID NO: 26207 - protein, 289 aa, Lotus japonicus
MAKDIETEAPRGDQLAHKDYHDPPPAPLFDTTELTKWSFYRALIAEFVATLLFLYITVLTVIGYSSQTDPANTTDPCGGVGILGIAWAFGGMIFILVYCTAGISGGHINPAVTFGLFLARKVSLVRALFYMVAQCLGAISGVGLVKAFQKSYYNRYHGGANMLADGYSKGTGLGAEIIGTFVLVYTVFSATDPKRNARDSHVPVLAPLPIGFAVFMVHLATIPITGTGINPARSFGAAVIYNNEKAWDDQWIFWVGPFIGATIAAIYHQYVLRAQAAKALGSFRSSGHL

SEQ ID NO: 26208 - protein, 288 aa, Panicum virgatum
MAKDIEASGPEAGEFSAKDYTDPPPAPLIDAEELTKWSLYRAVIAEFIATLLFLYITVATVIGYKHQTDAAASGPDAACGGVGVLGIAWAFGGMIFILVYCTAGISGGHINPAVTFGLFLARKVSLVRALLYIVAQCLGAICGVGLVKGFQSAYFVRYGGGANELSDGYSKGTGLAAEIIGTFVLVYTVFSATDPKRNARDSHVPVLAPLPIGFAVFMVHLATIPITGTGINPARSLGAAVIYNKDKAWDDQWIFWVGPLIGAAIAAAYHQYVLRASAAKLGSYRSNA

SEQ ID NO: 26209 - protein, 283 aa, Raphanus sativus
MAKEVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 26210 - protein, 283 aa, Raphanus sativus
MAKEVEGAEGYAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTWTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 26211 - protein, 283 aa, Raphanus sativus
MAKEVEGAEGFATRDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 26212 - protein, 289 aa, Helianthus annuus
MTKDVEVAEHHGGGSEYAAKDYHDPPPAPFFDADELTKWSFYRALIAEFVATLLFLYVTVLTVIGYKSQTDPKLDLDQCGGVGILGIAWAFGGMIFILVYCTAGISGGHINPAVTFGLFLARKVSLIRALGYMIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAFAAAVYHQFVLRAAAIKALGSFRSNA

SEQ ID NO: 26213 - protein, 285 aa, Helianthus annuus
MTKDIEVTEHHGGSSEYAAKDYHDPPPAPLFDAEELTKWSFYRALIAEFVATLLFLYVTVLTVIGYKSQTDPKLDLDQCGGVGILGIAWAFGGMIFILVYCTAGISGGHINPAVTFGLFLARKVSLVRAVGYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAFAAAVYHQFVLRAGAIKALGSF

SEQ ID NO: 26214 - protein, 287 aa, Brassica napus
  Sequence also found in Organisms: Brassica juncea, Brassica oleracea, Brassica rapa
MAKDVEAVSGEGFQTRDYQDPPPAPLFDPAELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFVGAAIAAFYHQFVLRASGSKSLGSFRSAANV

SEQ ID NO: 26215 - protein, 287 aa, Artemisia annua
MTKDVEVAEHHGGEYTSKDYHDPPPAPFFDADELTKWSFYRALIAEFVATLLFLYVTVLTVIGYKSQTDPDLNLDQCGGVGILGIAWAFGGMIFILVYCTAGISGGHINPAVTFGLFVARKVSLIRALGYMIAQCLGAICGVGLVKAFQSSYYNRYGGGANTLADGYNKGTGLGAEIIGTFVLVYTVFSATDPKRSARDSHVPVLAPLPIGFAVFMVHLATIPITGTGINPARSFGAAVIFNDDKAWDDQWIFWVGPFIGAFAAALYHQFVLRAAAIKALGSFRSNA

SEQ ID NO: 26216 - protein, 287 aa, Raphanus sativus
MAKDVEAVAGEGFQTRDYQDPPPAPLFDPEELTKWSFYRAVIAEFVATLLFLYITILTVIGYKVQTDSTAGGVDCGGVGILGIAWAFGGMIFILVYCTAGISGGHINPAVTFGLLLARKVSLVRAILYMVAQCLGAICGVGFVKAFQSAYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWLGPFIGAAIAAVYHQFVLRASGSKSLGSFRSAANV

SEQ ID NO: 26217 - protein, 280 aa, Carthamus tinctorius
MTKDVEVAEHHGGSDYAAKDYHDPPPAPLIDGEELTKWSFYRAVIAEFVATLLFLYITVLTVIGYKSQTDPTLNTDQCGGVGILGIAWAFGGMIFVLVYCTAGISGGHINPAVTFGLFLARKVSLIRAVAYMVAQCAGAICGVGFVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAAAAAFYHQFVLRAGAIKA

SEQ ID NO: 26218 - protein, 287 aa, Arabidopsis thaliana
MAKDVEAVPGEGFQTRDYQDPPPAPFIDGAELKKWSFYRAVIAEFVATLLFLYITVLTVIGYKIQSDTDAGGVDCGGVGILGIAWAFGGMIFILVYCTAGISGGHINPAVTFGLFLARKVSLPRALLYIIAQCLGAICGVGFVKAFQSSYYTRYGGGANSLADGYSTGTGLAAEIIGTFVLVYTVFSATDPKRSARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 26219 - protein, 285 aa, Brassica napus
  Sequence also found in Organisms: Brassica juncea
MAKEVEGAEGFATRDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 26220 - protein, 285 aa, Brassica napus
  Sequence also found in Organisms: Brassica oleracea, Brassica rapa
MAKEVEGAEGFASRDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 26221 - protein, 285 aa, Brassica napus
MAKDVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 26222 - protein, 285 aa, Brassica napus
  Sequence also found in Organisms: Brassica rapa
MAKDVEGAEGFAARDYQDPPPTPFFDAEELTRWSLYRAVIAEFVATLLFLYVTVLTVIGYKISSDTTAGGVECGGVGILGIAWAFGGMIFILVYCTAGISGGHINPAVTFGLFLARKVTLVRALLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 26223 - protein, 289 aa, Lactuca sativa
MTKDVEVAEHHGGGGEYTAKDYHDPPPAPFFDADELTKWSFYRALIAEFVATLLFLYVTVLTVIGYKSQTDPALDLDQCGGVGILGIAWAFGGMIFILVYCTAGISGGHINPAVTFGLFLARKVSLIRAVGYMIAQCLGAICGVGLVKAFQSSYYDRYGGGANELADGYNKGTGLGAEIIGTFVLVYTVFSATDPKRSARDSHVPVLAPLPIGFAVFMVHLATIPITGTGINPARSFGAAVIYNKAKAWDDQWIFWVGPFIGALAAAVYHQFVLRAAAIKALGSFRSNA

SEQ ID NO: 26224 - protein, 289 aa, Helianthus annuus
MTKDVEVAEHHGGGSEYTAKDYHDPPPAPFFDADELTKWSFYRALIAEFVATLLFLYVTVLTVIGYKSQTDPKLDLDQCGGVGILGIAWAFGGMIFILVYCTAGISGGHINPAVTFGLFLARKVSLIRALGYMIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAFAAAVYHQFVLRAAAIKALGSFRSNA

SEQ ID NO: 26225 - protein, 286 aa, Glycine max
MAKDVEVQEQGGEYSAKDYHDPPPAPLFDPEELTQWSFYRALIAEFIATLLFLYVTVLTIIGYKRQTDTTVGGTDCDGVGILGIAWAFGGMIFILVYCTAGISGGHINPAVTFGLFLGRKVSLIRALLYMVAQCAGAICGTGLAKGFQKAYYNRYGGGANSVADGYNNGTALGAEIIGTFVLVYTVFSATDPKRNARDSHVPVLAPLPIGFAVFMVHLATIPITGTGINPARSFGAAVIYNEDKIWDDQWIFWVGPIVGAAVAAFYHQYILRAAAIKALGSFRSNA

SEQ ID NO: 26226 - protein, 285 aa, Brassica juncea
MAKDVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 26227 - protein, 287 aa, Vitis vinifera
MAKDIEVAGHGDLTLKDYHDPPPAPLVDPEELGSWSFYRAIIAEFVATLLFLYVTVLTVIGYKNQTDPYHHGNECNGVGILGIAWAFGGMIFILVYCTAGISGGHINPAVTFGLFLARKVSLVRAVMYMVAQCGGAICGCGLVKLFQDIYYIRYGGGANELASGYSIGTGLAAEIIGTFVLVYTVFSATDPKRNARDSHVPVLAPLPIGFAVFMVHLATIPITGTGINPARSLGAAVIYNQPKAWSDHWVFWAGPFIGAAIAAFYHQFILRAGAVKALGSFKSSSHM

SEQ ID NO: 26228 - protein, 291 aa, Gossypium hirsutum
MTKDIETTAEQGGGAEFSAKDYQDPPPAPLIDLEELTKWSLYRAAIAEFIATLLFLYVTVLTVIGYKVQTDPVKNTVDPDCGGVGILGIAWAFGGMIFILVYCTAGISGGHINPAVTFGLFVGRKVSLIRALLYMVAQCLGAICGCGLVKAFQKTYYNSYGGGANELQDGFNKGTGLGAEIIGTFVLVYTVFSATDPKRSARDSHVPVLAPLPIGFAVFMVHLATIPITGTGINPARSFGAAVIYNQEKAWDDQWIFWVGPFIGAFVAAFYHQYILRAAAIKALGSFRSNA

SEQ ID NO: 26229 - protein, 289 aa, Zea mays
MAKQDIEASGPEAGEFSAKDYTDPPPAPLIDADELTKWSLYRAVIAEFIATLLFLYITVATVIGYKHQTDAAASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 26230 - protein, 285 aa, Vigna unguiculata
MAKDVEVQEQGEYSAKDYHDPPPAPLFDPEELTQWSFYRALIAEFIATLLFLYVTVLTIIGYKRQTDANVGGTECDGVGILGIAWAFGGMIFILVYCTAGISGGHINPAVTFGLFLGRKVSLIRALLYMVAQCAGAICGTGLAKGFQKAYYNRYGGGANSVADGYNKGTALGAEIIGTFVLVYTVFSATDPKRNARDSHVPVLAPLPIGFAVFMVHLATIPVTGTGINPARSFGAAVIYNDEKIWDDQWIFWVGPIVGAAVAAFYHQYILRAAAIKALGSFRSNA

SEQ ID NO: 26231 - protein, 289 aa, Liriodendron tulipifera
MGKDVEGAEHGEFTTKDYTDPPPAPLIDVDELTQWSFYRALIAEFIATLLFLYITVATVIGYKSEVDPTKNPAPDACSGVGILGIAWAFGGMIFILVYCTAGISGGHINPAVTFGLFLARKVSLIRAVLYMVAQCLGAICGVGLVKGFQKSYYQKYGGGANELAPGYNKGTGLGAEIIGTFVLVYTVFSATDPKRNARDSHVPVLAPLPIGFAVFMVHLATIPITGTGINPARSFGAAVIYNKDKAWDDQWIFWVGPFIGAAIAAAYHQYILRAAAIKALGSFRSNPHV

SEQ ID NO: 26232 - protein, 287 aa, Medicago truncatula
MAKDIEAEPQGGVPHKDYHDPPPAPLFDTAELGQWSFYRALIAEFVATLLFLYVTVLTVIGYNAQTDPAHNGTNCDGVGILGIAWAFGGMIFVLVYCTAGISGGHINPAVTFGLFLARKVSLIRAVLYMVAQCLGAICGVGLVKAFQKGYYNRYKGGANMLSAGYSKGTGLGAEIIGTFVLVYTVFSATDPKRNARDSHVPVLAPLPIGFAVFMVHLATIPITGTGINPARSFGAAVIYNNEKAWDDQWIFWVGPFIGAAIAAIYHQFVLRAQAAKALGSFRSSSNL

SEQ ID NO: 26233 - protein, 287 aa, Nicotiana benthamiana
  Sequence also found in Organisms: Nicotiana tabacum
MTKEVEVATEQPTEFSAKDYTDPPPAPLVDFEELTQWSLYRAVIAEFIATLLFLYVTVLTVIGYKVQSDVKADGDICGGVGILGIAWAFGGMIFILVYCTAGISGGHINPAVTFGLFLARKVSLIRAVLYMVAQCLGAICGVGFVKAFQSAYYVRYGGGANVMAPGHTKGVGLAAEIIGTFVLVYTVFSATDPKRNARDSHVPVLAPLPIGFAVFMVHLATIPITGTGINPARSFGAAVIYNHDKAWDEHWIFWVGPFIGAFAAAVYHQFILRAGAIKALGSFRSNA

SEQ ID NO: 26234 - protein, 288 aa, Oryza sativa
MAKDIEASAPEGGEFSAKDYTDPPPAPLIDVEELTKWSLYRAVIAEFIATLLFLYITVATVIGYKHQSDATVNTTDAACSGVGILGIAWAFGGMIFILVYCTAGISGGHINPAVTFGLFLARKVSLIRAVLYIIAQCLGAICGVGLVKGFQSSYYARYGGGANELSDGYSKGTGLGAEIIGTFVLVYTVFSATDPKRNARDSHIPVLAPLPIGFAVFMVHLATIPITGTGINPARSLGTAVIYNKDKAWDDQWIFWVGPLIGAAIAAAYHQYVLRASAAKLGSYRSNA

SEQ ID NO: 26235 - protein, 280 aa, Carthamus tinctorius
MTKDVEVAEQHHGGKDYHDPPPSPLFDADELTKWSFYRALIAEFVATLLFLYVTVLTVIGYKSQTDPLLNTDQCGGVGILGIAWAFGGMIFILVYCTAGISGGHINPAVTFGLFLARKVSLIRAVGYMVAQCLGAICGVGLVKAFQSSYYNRYGGGANTLADGYNKGTGLGAEIIGTFVLVYTVFSATDPKRSARDSHVPVLAPLPIGFAVFMVHLATIPITGTGINPARSFGAAVIFNDDKAWDDHWIFWVGPFIGAFAAAVYHQFVLRAAAIKALGSF

SEQ ID NO: 26236 - protein, 280 aa, Solanum lycopersicum
MTKEVTDFSAKDYTDPPPAPLVDFEELRQWSFYRAIIAEFIATLLFLYVTILTVIGYKHQADVDAGGDVCGGVGILGIAWAFGGMIFILVYCTAGISGGHINPAVTFGLFLARKVSLIRAVLYMVAQCLGAICGVGFVKAFQSAYYNRYGGGVNVMAGGHSKGVGLGAEIIGTFVLVYTVFSATDPKRNARDSHVPVLAPLPIGFAVFMVHLATIPVTGTGINPARSFGAAVIFNGDKAWDEHWIFWVGPFIGAFIAAFYHQFVLRAGAIKALGSFRSTA

SEQ ID NO: 26237 - protein, 268 aa, Carthamus tinctorius
DRLLLRQDYHDPPPAPFIDPGELTKWSFYRAIIAEFVATLLFLYITVLTVIGYKAQTDPAKNLDQCGGVGILGIAWAFGGMIFVLVYCTAGISGGHINPAVTFGLFLARKVSLIRAITYMVAQCLGAICGVGLVKAFHKTYYNNYGGGANELADGYNKGTGLGAEIIGTFVLVYTVFSATDPKRSARDSHVPVLAPFPIGFAVFMVHLATIPITGTGINPARSLGAAVIYNKEKAWDDQWIFWVGPFIGAAIAAFYHQFILRAGAVKA

SEQ ID NO: 26238 - protein, 286 aa, Solanum tuberosum
MTKEVESVTERGEFSAKDYTDPPPAPLVDFEELTQWSFYRAIIAEFIATLLFLYITILTVIGYQHQADVDAGGDVCGGVGILGIAWAFGGMIFILVYCTAGISGGHINPAVTFGLFLARKVSLIRAVLYMVAQCLGAICGVGFVKAFQSAYYNRYGGGVNVMAAGHNKGVGLGAEIIGTFVLVYTVFSATDPKRNARDSHVPVLAPLPIGFAVFMVHLATIPITGTGINPARSFGAAVIYNGDKAWDEHWIFWVGPFIGAFIAAFYHQFVLRAGAIKALGSFRSNA

SEQ ID NO: 26239 - protein, 286 aa, Glycine max
MAKDVEVQEQGGEYSAKDYHDPPPAPLFDPEELTQWSFYRALIAEFIATLLFLYVTVLTIIGYKRQTDATLGGTECDGVGILGIAWAFGGMIFILVYCTAGISGGHINPAVTFGLFLGRKVSLIRALLYMVAQCAGAICGTGLAKGFQKSYYNRYGGGANSVADGYNNGTALGAEIIGTFVLVYTVFSATDPKRNARDSHVPVLAPLPIGFAVFMVHLATIPITGTGINPARSFGAAVIYNKDKIWDDQWIFWVGPIVGAAVAAFYHQYILRAAAIKALGSFRSNA

SEQ ID NO: 26240 - protein, 285 aa, Brassica napus
  Sequence also found in Organisms: Brassica oleracea
MAKDVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLIRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIFNESKPWNDHWIFWVGPFIGAAIAAFYHQFVLRASGSKSLGSFRSAANV

SEQ ID NO: 26241 - protein, 287 aa, Phaseolus vulgaris
MAKDVEQVTEQPEYSAKDYHDPPPAPLFDPDELTKWSLYRAAIAEFIATLLFLYITVLTIIGYKRQTDTSIPGNTECDGVGILGIAWAFGGMIFILVYCTAGISGGHINPAVTLGLFLGRKVSLVRALLYIVAQCAGAISGAGLAKAFQKSFYNRYGGGANTVSDGYNKGTALGAEIIGTFVLVYTVFSATDPKRNARDSHVPVLAPLPIGFAVFMVHLATIPITGTGINPARSFGPAVIFNNDKAWDDQWIYWVGPFIGAAVAAFYHQYILRAAAIKALGSFRSNA

SEQ ID NO: 26242 - protein, 286 aa, Nicotiana benthamiana
TKEVEVATEQPTEFSAKDYTDPPPAPLVDFEELTQWSLYRAVIAEFIATLLFLYVTVLTVIGYKVQSDVKADGDICGGVGILGIAWAFGGMIFILVYCTAGISGGHINPAVTFGLFLARKVSLIRAVLYMVAQCLGAICGVGFVKAFQSAYYVRYGGGANVMAPGHTKGVGLAAEIIGTFVLVYTVFSATDPKRNARDSHVPVLAPLPIGFAVFMVHLATIPITGTGINPARSFGAAVIYNHDKAWDEHWIFWVGPFIGAFAAAVYHQFILRAGAIKALGSFRSNA

SEQ ID NO: 26243 - protein, 283 aa, Cryptomeria japonica
MAKEEGKEVVEQQGLAAKDYTDPPPAPLVDFEEFKLWSFYRALIAEFIATLLFLYITVATVIGHKRTAANCGSVGILGIAWAFGGMIFVLVYCTAGISGGHINPAVTFGLFLARKVSLPRAVLYMVAQCLGAICGVGLVKAFQKSFYDMYGGGANSVAPGYSKGTGLGAEIIGTFVLVYTVFSATDPKRSARDSHVPVLAPLPIGFAVFMVHLATIPITGTGINPARSFGAAVIYGHDKIWDDQWIFWVGPFLGAFAAAFYHQYILRAAAIKALGSFRSNPNV

SEQ ID NO: 26244 - DNA, 33 bp, Artificial Sequence
  Primer
aaaaactcgagaattaagtgccaaacatccaac

SEQ ID NO: 26245 - DNA, 33 bp, Artificial Sequence
  Primer
aaaaactcgagactgctttattagggagggtgg

SEQ ID NO: 26246 - DNA, 35 bp, Artificial Sequence
  Primer
aaaaactcgagacttttacctctggaatttgatgc

SEQ ID NO: 26247 - DNA, 31 bp, Artificial Sequence
  Primer
aaaaactcgagcccacattggagaaagatcg

SEQ ID NO: 26248 - DNA, 33 bp, Artificial Sequence
  Primer
aaaaactcgagctcggtacacggtacatcagtg

SEQ ID NO: 26249 - DNA, 33 bp, Artificial Sequence
  Primer
aaaaactcgaggcctaagtgcacacatacaacg

SEQ ID NO: 26250 - DNA, 33 bp, Artificial Sequence
  Primer
aaaaactcgaggcgctacagagtcacagttcag

SEQ ID NO: 26251 - DNA, 33 bp, Artificial Sequence
  Primer
aaaaactcgaggtgtgaatattggaagccagtg

SEQ ID NO: 26252 - DNA, 33 bp, Artificial Sequence
  Primer
aaaaactcgagtatgtttcatgtgtgcgtcaag

SEQ ID NO: 26253 - DNA, 33 bp, Artificial Sequence
  Primer
aaaaactcgagtccaaagagcaacatgactacg

SEQ ID NO: 26254 - DNA, 33 bp, Artificial Sequence
  Primer
aaaaactcgagttaagccaggaagaatgaatgc

SEQ ID NO: 26255 - DNA, 33 bp, Artificial Sequence
  Primer
aaaaactcgagttaatggaaatgcaatgacagg

SEQ ID NO: 26256 - DNA, 33 bp, Artificial Sequence
  Primer
aaaaactcgagttcaacatgttttctcacccaa

SEQ ID NO: 26257 - DNA, 31 bp, Artificial Sequence
  Primer
aaaaactcgagttgattcaagcacaagatcg

SEQ ID NO: 26258 - DNA, 34 bp, Artificial Sequence
  Primer
aaaaactcgagttggcaaatctaaaattaagtgc

SEQ ID NO: 26259 - DNA, 34 bp, Artificial Sequence
  Primer
aaaaagaattcaaaccttaactagccacgagacc

SEQ ID NO: 26260 - DNA, 33 bp, Artificial Sequence
  Primer
aaaaagaattcaaatccgtatctgtgtccatcg

SEQ ID NO: 26261 - DNA, 34 bp, Artificial Sequence
  Primer
aaaaagaattcaacgatttgatgaaacacagtcc

SEQ ID NO: 26262 - DNA, 33 bp, Artificial Sequence
  Primer
aaaaagaattcacaagattgccaccaaactttc

SEQ ID NO: 26263 - DNA, 33 bp, Artificial Sequence
  Primer
aaaaagaattcacaggcagctgtagtgagtgag

SEQ ID NO: 26264 - DNA, 33 bp, Artificial Sequence
  Primer
aaaaagaattcacaggttgtagaggcgattctg

SEQ ID NO: 26265 - DNA, 32 bp, Artificial Sequence
  Primer
aaaaagaattcacagttccaggcttccagttc

SEQ ID NO: 26266 - DNA, 33 bp, Artificial Sequence
  Primer
aaaaagaattcaccaaactttcatttgagcacc

SEQ ID NO: 26267 - DNA, 33 bp, Artificial Sequence
  Primer
aaaaagaattcaccatgttccggacagaactac

SEQ ID NO: 26268 - DNA, 33 bp, Artificial Sequence
  Primer
aaaaagaattcacggtatcggtacagcattcac

SEQ ID NO: 26269 - DNA, 33 bp, Artificial Sequence
  Primer
aaaaagaattcagaaacaccagcatgttcactg

SEQ ID NO: 26270 - DNA, 33 bp, Artificial Sequence
  Primer
aaaaagaattcagagggcaagataaatgcacac

SEQ ID NO: 26271 - DNA, 33 bp, Artificial Sequence
  Primer
aaaaagaattcagcaaatccactgaacaagctc

SEQ ID NO: 26272 - DNA, 32 bp, Artificial Sequence
  Primer
aaaaagaattcagggttcgtgctcgattagac

SEQ ID NO: 26273 - DNA, 33 bp, Artificial Sequence
  Primer
aaaaagaattcagtagtgtttcgttcctgctgc

SEQ ID NO: 26274 - DNA, 32 bp, Artificial Sequence
  Primer
aaaaagaattcataaaccgttccagatggctg

SEQ ID NO: 26275 - DNA, 33 bp, Artificial Sequence
  Primer
aaaaagaattcatacaggttcttcagcaggcag

SEQ ID NO: 26276 - DNA, 33 bp, Artificial Sequence
  Primer
aaaaagaattcatcacattagccagacctccac

SEQ ID NO: 26277 - DNA, 33 bp, Artificial Sequence
  Primer
aaaaagaattcatctagcagacacggacgacac

SEQ ID NO: 26278 - DNA, 33 bp, Artificial Sequence
  Primer
aaaaagaattcatctcaccatatgcaatgcaac

SEQ ID NO: 26279 - DNA, 33 bp, Artificial Sequence
  Primer
aaaaagaattcattgtggctaaagtggcatctc

SEQ ID NO: 26280 - DNA, 33 bp, Artificial Sequence
  Primer
aaaaagaattcatttgccaattctccttgagtc

SEQ ID NO: 26281 - DNA, 33 bp, Artificial Sequence
  Primer
aaaaagaattccaagaacattgcggatctacac

SEQ ID NO: 26282 - DNA, 33 bp, Artificial Sequence
  Primer
aaaaagaattccactggcattgggcttattaac

SEQ ID NO: 26283 - DNA, 32 bp, Artificial Sequence
  Primer
aaaaagaattccagcgagagacaagtgttgtg

SEQ ID NO: 26284 - DNA, 32 bp, Artificial Sequence
  Primer
aaaaagaattccagctacaactcgtgtggtcc

SEQ ID NO: 26285 - DNA, 33 bp, Artificial Sequence
  Primer
aaaaagaattccaggcataacatctgacgattg

SEQ ID NO: 26286 - DNA, 34 bp, Artificial Sequence
  Primer
aaaaagaattccagtaatccagagacaccgtagc

SEQ ID NO: 26287 - DNA, 33 bp, Artificial Sequence
  Primer
aaaaagaattccattggctgctactcagaaagc

SEQ ID NO: 26288 - DNA, 35 bp, Artificial Sequence
  Primer
aaaaagaattcccacaccataatgcagattattcc

SEQ ID NO: 26289 - DNA, 33 bp, Artificial Sequence
  Primer
aaaaagaattcccacgagaccaaaccagtaatc

SEQ ID NO: 26290 - DNA, 33 bp, Artificial Sequence
  Primer
aaaaagaattcccatagtgtgaaccgtgacaag

SEQ ID NO: 26291 - DNA, 33 bp, Artificial Sequence
  Primer
aaaaagaattcccctctgctaatccactttacg

SEQ ID NO: 26292 - DNA, 31 bp, Artificial Sequence
  Primer
aaaaagaattccgaaggcacgagaaacagag

SEQ ID NO: 26293 - DNA, 34 bp, Artificial Sequence
  Primer
aaaaagaattccgagctcaagctaaaccctaaac

SEQ ID NO: 26294 - DNA, 33 bp, Artificial Sequence
  Primer
aaaaagaattccgctcatctgtgatgatttgag

SEQ ID NO: 26295 - DNA, 33 bp, Artificial Sequence
  Primer
aaaaagaattccgctcctttcatcttctcttcc

SEQ ID NO: 26296 - DNA, 33 bp, Artificial Sequence
  Primer
aaaaagaattccgggataatcgtcttctctgtg

SEQ ID NO: 26297 - DNA, 33 bp, Artificial Sequence
  Primer
aaaaagaattccggtattattgcgtgaaagagg

SEQ ID NO: 26298 - DNA, 33 bp, Artificial Sequence
  Primer
aaaaagaattccgtatatgcatctgggctactg

SEQ ID NO: 26299 - DNA, 32 bp, Artificial Sequence
  Primer
aaaaagaattccgtttccgtcgattcaggtag

SEQ ID NO: 26300 - DNA, 36 bp, Artificial Sequence
  Primer
aaaaagaattcctaaaatgctgccacagtgagtaag

SEQ ID NO: 26301 - DNA, 36 bp, Artificial Sequence
  Primer
aaaaagaattcctaaccgcagtagcaacgaattaac

SEQ ID NO: 26302 - DNA, 36 bp, Artificial Sequence
  Primer
aaaaagaattcctaagaagatccacaacacacttgc

SEQ ID NO: 26303 - DNA, 36 bp, Artificial Sequence
  Primer
aaaaagaattcctaaggacctaaggtgaaaccaagc

SEQ ID NO: 26304 - DNA, 33 bp, Artificial Sequence
  Primer
aaaaagaattcctacaccagtaccatcccatcg

SEQ ID NO: 26305 - DNA, 35 bp, Artificial Sequence
  Primer
aaaaagaattcctacatctccagcaaatgtccaag

SEQ ID NO: 26306 - DNA, 36 bp, Artificial Sequence
  Primer
aaaaagaattcctaccaatctgggtcaataaaccac

SEQ ID NO: 26307 - DNA, 33 bp, Artificial Sequence
  Primer
aaaaagaattcctacccaagtacccagcctttc

SEQ ID NO: 26308 - DNA, 35 bp, Artificial Sequence
  Primer
aaaaagaattcctacctcaaccaactcaaaggacc

SEQ ID NO: 26309 - DNA, 36 bp, Artificial Sequence
  Primer
aaaaagaattcctagcaacagcaatatgacaccaac

SEQ ID NO: 26310 - DNA, 36 bp, Artificial Sequence
  Primer
aaaaagaattcctaggaagcttggagaacaatcaag

SEQ ID NO: 26311 - DNA, 35 bp, Artificial Sequence
  Primer
aaaaagaattcctagttcattctgcacacctttgg

SEQ ID NO: 26312 - DNA, 34 bp, Artificial Sequence
  Primer
aaaaagaattcctatcccatctccagcaaatgtc

SEQ ID NO: 26313 - DNA, 33 bp, Artificial Sequence
  Primer
aaaaagaattcctcagagatcatgagcagcaag

SEQ ID NO: 26314 - DNA, 32 bp, Artificial Sequence
  Primer
aaaaagaattcctccgggataatcgtcttctc

SEQ ID NO: 26315 - DNA, 33 bp, Artificial Sequence
  Primer
aaaaagaattcctcctccgagctcaagctaaac

SEQ ID NO: 26316 - DNA, 33 bp, Artificial Sequence
  Primer
aaaaagaattcctcggaacaaattgtggatttc

SEQ ID NO: 26317 - DNA, 33 bp, Artificial Sequence
  Primer
aaaaagaattcctctaaccctcagcatccacag

SEQ ID NO: 26318 - DNA, 33 bp, Artificial Sequence
  Primer
aaaaagaattcctctctcaacggtcctctaacc

SEQ ID NO: 26319 - DNA, 33 bp, Artificial Sequence
  Primer
aaaaagaattccttctcttctctcctccacgtc

SEQ ID NO: 26320 - DNA, 32 bp, Artificial Sequence
  Primer
aaaaagaattcgaaaaatggatcccaagaaca

SEQ ID NO: 26321 - DNA, 33 bp, Artificial Sequence
  Primer
aaaaagaattcgagaaactactgccagctcagg

SEQ ID NO: 26322 - DNA, 33 bp, Artificial Sequence
  Primer
aaaaagaattcgagccaacacaaaccctatcac

SEQ ID NO: 26323 - DNA, 33 bp, Artificial Sequence
  Primer
aaaaagaattcgagctttcttgcgtgttgtagc

SEQ ID NO: 26324 - DNA, 33 bp, Artificial Sequence
  Primer
aaaaagaattcgagggagtacgtaggattgagc

SEQ ID NO: 26325 - DNA, 33 bp, Artificial Sequence
  Primer
aaaaagaattcgcagtttcatggcttcaagtag

SEQ ID NO: 26326 - DNA, 33 bp, Artificial Sequence
  Primer
aaaaagaattcgcattattgttgcctggatatg

SEQ ID NO: 26327 - DNA, 34 bp, Artificial Sequence
  Primer
aaaaagaattcgctgatacccagtcaaatacacc

SEQ ID NO: 26328 - DNA, 34 bp, Artificial Sequence
  Primer
aaaaagaattcgcttggaactgcaaatgtgttac

SEQ ID NO: 26329 - DNA, 33 bp, Artificial Sequence
  Primer
aaaaagaattcggaaagcatgcaccagttaaag

SEQ ID NO: 26330 - DNA, 33 bp, Artificial Sequence
  Primer
aaaaagaattcggagcttccattccaaactagg

SEQ ID NO: 26331 - DNA, 35 bp, Artificial Sequence
  Primer
aaaaagaattcggagtacgtaggattgagcaaatg

SEQ ID NO: 26332 - DNA, 31 bp, Artificial Sequence
  Primer
aaaaagaattcggatatcgattcctccctcc

SEQ ID NO: 26333 - DNA, 32 bp, Artificial Sequence
  Primer
aaaaagaattcggcacgagaaacagagagagc

SEQ ID NO: 26334 - DNA, 33 bp, Artificial Sequence
  Primer
aaaaagaattcggcagaatcaggactcagtttc

SEQ ID NO: 26335 - DNA, 33 bp, Artificial Sequence
  Primer
aaaaagaattcggcattgatgagatgcatacag

SEQ ID NO: 26336 - DNA, 33 bp, Artificial Sequence
  Primer
aaaaagaattcggcgattctgtcctaagtttcc

SEQ ID NO: 26337 - DNA, 33 bp, Artificial Sequence
  Primer
aaaaagaattcgtcgaacaattaaacatggtgg

SEQ ID NO: 26338 - DNA, 31 bp, Artificial Sequence
  Primer
aaaaagaattcgtgaggcagagtgaccacag

SEQ ID NO: 26339 - DNA, 33 bp, Artificial Sequence
  Primer
aaaaagaattcgttgctagcttaggccactgag

SEQ ID NO: 26340 - DNA, 33 bp, Artificial Sequence
  Primer
aaaaagaattctaaacgcacatcatctttcctg

SEQ ID NO: 26341 - DNA, 33 bp, Artificial Sequence
  Primer
aaaaagaattctaatgtaagtggctcctcggac

SEQ ID NO: 26342 - DNA, 33 bp, Artificial Sequence
  Primer
aaaaagaattctacacgaatcatgcattccaag

SEQ ID NO: 26343 - DNA, 33 bp, Artificial Sequence
  Primer
aaaaagaattctacatttgcatgtcaatgcctc

SEQ ID NO: 26344 - DNA, 33 bp, Artificial Sequence
  Primer
aaaaagaattctagtctgtggaccaatcaatcg

SEQ ID NO: 26345 - DNA, 33 bp, Artificial Sequence
  Primer
aaaaagaattctcaaagcactagcagcaaattc

SEQ ID NO: 26346 - DNA, 33 bp, Artificial Sequence
  Primer
aaaaagaattctcccaaactttcagtccagaac

SEQ ID NO: 26347 - DNA, 35 bp, Artificial Sequence
  Primer
aaaaagaattctctaacctaggagcatacaggcac

SEQ ID NO: 26348 - DNA, 33 bp, Artificial Sequence
  Primer
aaaaagaattctctctttataaggcccttgtgg

SEQ ID NO: 26349 - DNA, 33 bp, Artificial Sequence
  Primer
aaaaagaattctcttgttcctgtacattgctgc

SEQ ID NO: 26350 - DNA, 36 bp, Artificial Sequence
  Primer
aaaaagaattctgaaataaatcaaagcactagcagc

SEQ ID NO: 26351 - DNA, 33 bp, Artificial Sequence
  Primer
aaaaagaattctgatctcaagttcttggcattg

SEQ ID NO: 26352 - DNA, 33 bp, Artificial Sequence
  Primer
aaaaagaattctgattctgacgttctcacttcc

SEQ ID NO: 26353 - DNA, 33 bp, Artificial Sequence
  Primer
aaaaagaattctgcagaagaggttaaagggttg

SEQ ID NO: 26354 - DNA, 33 bp, Artificial Sequence
  Primer
aaaaagaattctgtagatcaagattggcagctc

SEQ ID NO: 26355 - DNA, 33 bp, Artificial Sequence
  Primer
aaaaagaattctgtgtacaatggtgactgatgc

SEQ ID NO: 26356 - DNA, 34 bp, Artificial Sequence
  Primer
aaaaagaattcttaaccattccttccttgtcctc

SEQ ID NO: 26357 - DNA, 33 bp, Artificial Sequence
  Primer
aaaaagaattcttaaccgagtaaccgactgtgc

SEQ ID NO: 26358 - DNA, 34 bp, Artificial Sequence
  Primer
aaaaagaattcttgatagacagacacaggcacag

SEQ ID NO: 26359 - DNA, 33 bp, Artificial Sequence
  Primer
aaaaagaattcttgctcttgtgcagttatgctc

SEQ ID NO: 26360 - DNA, 33 bp, Artificial Sequence
  Primer
aaaaagatatcagctgggtcactcacaattctc

SEQ ID NO: 26361 - DNA, 31 bp, Artificial Sequence
  Primer
aaaaagatatccctagccatttcgacagtca

SEQ ID NO: 26362 - DNA, 31 bp, Artificial Sequence
  Primer
aaaaagatatcgtagctgctgcatccagttc

SEQ ID NO: 26363 - DNA, 33 bp, Artificial Sequence
  Primer
aaaaagtcgactcatcaagaaccaacattcaac

SEQ ID NO: 26364 - DNA, 31 bp, Artificial Sequence
  Primer
aaaaggcctaacaatgctcatgaaccatcac

SEQ ID NO: 26365 - DNA, 31 bp, Artificial Sequence
  Primer
aaaaggcctaacacacctacggtttcgactc

SEQ ID NO: 26366 - DNA, 35 bp, Artificial Sequence
  Primer
aaaaggcctaatcttaccaactgccaaatttctac

SEQ ID NO: 26367 - DNA, 31 bp, Artificial Sequence
  Primer
aaaaggcctacaaagcaatggcaatagaagc

SEQ ID NO: 26368 - DNA, 31 bp, Artificial Sequence
  Primer
aaaaggcctacaattgacatcactggctgag

SEQ ID NO: 26369 - DNA, 31 bp, Artificial Sequence
  Primer
aaaaggcctacacaaccagtgattggtcttc

SEQ ID NO: 26370 - DNA, 31 bp, Artificial Sequence
  Primer
aaaaggcctaccgaggacaacaaggacatac

SEQ ID NO: 26371 - DNA, 31 bp, Artificial Sequence
  Primer
aaaaggcctactagccgtatcctgtctgtcg

SEQ ID NO: 26372 - DNA, 31 bp, Artificial Sequence
  Primer
aaaaggcctactcctgaagctcttaccgagg

SEQ ID NO: 26373 - DNA, 33 bp, Artificial Sequence
  Primer
aaaaggcctactggtacaaatctcagttgttgc

SEQ ID NO: 26374 - DNA, 31 bp, Artificial Sequence
  Primer
aaaaggcctagagttgcattgcgcagtattc

SEQ ID NO: 26375 - DNA, 31 bp, Artificial Sequence
  Primer
aaaaggcctagatggtcaaacagggtacagg

SEQ ID NO: 26376 - DNA, 31 bp, Artificial Sequence
  Primer
aaaaggcctaggaagaagaccagggaaactg

SEQ ID NO: 26377 - DNA, 31 bp, Artificial Sequence
  Primer
aaaaggcctagttcaaacgttacaacgccag

SEQ ID NO: 26378 - DNA, 31 bp, Artificial Sequence
  Primer
aaaaggcctataatccatctggttcccaagc

SEQ ID NO: 26379 - DNA, 31 bp, Artificial Sequence
  Primer
aaaaggcctatatgctcttgcagatcgacag

SEQ ID NO: 26380 - DNA, 31 bp, Artificial Sequence
  Primer
aaaaggcctatcccttaccatgtccaatcag

SEQ ID NO: 26381 - DNA, 29 bp, Artificial Sequence
  Primer
aaaaggcctatcctcgcaaccactgtctc

SEQ ID NO: 26382 - DNA, 31 bp, Artificial Sequence
  Primer
aaaaggcctatccttgccattacacaaccag

SEQ ID NO: 26383 - DNA, 31 bp, Artificial Sequence
  Primer
aaaaggcctatgccagaagcatcaaattagg

SEQ ID NO: 26384 - DNA, 31 bp, Artificial Sequence
  Primer
aaaaggcctatggaacagaccaagttgatgg

SEQ ID NO: 26385 - DNA, 31 bp, Artificial Sequence
  Primer
aaaaggcctatgttgatcccttaccatgtcc

SEQ ID NO: 26386 - DNA, 31 bp, Artificial Sequence
  Primer
aaaaggcctattagctgattggtcaggttgc

SEQ ID NO: 26387 - DNA, 31 bp, Artificial Sequence
  Primer
aaaaggcctattcgttcagctcatccaagtc

SEQ ID NO: 26388 - DNA, 31 bp, Artificial Sequence
  Primer
aaaaggcctattgtatccattggagagggac

SEQ ID NO: 26389 - DNA, 32 bp, Artificial Sequence
  Primer
aaaaggcctcaaatcctgcacagctataatgg

SEQ ID NO: 26390 - DNA, 33 bp, Artificial Sequence
  Primer
aaaaggcctcaagatgatttgtatcaccagtgc

SEQ ID NO: 26391 - DNA, 35 bp, Artificial Sequence
  Primer
aaaaggcctcaatgacacttctctttacaacatcc

SEQ ID NO: 26392 - DNA, 31 bp, Artificial Sequence
  Primer
aaaaggcctcagctctagtcgtgttcgatcc

SEQ ID NO: 26393 - DNA, 31 bp, Artificial Sequence
  Primer
aaaaggcctcataccaccagacatactctgc

SEQ ID NO: 26394 - DNA, 31 bp, Artificial Sequence
  Primer
aaaaggcctcattcccatcatcatcagacag

SEQ ID NO: 26395 - DNA, 31 bp, Artificial Sequence
  Primer
aaaaggcctcattcgtggaaacattgtcatc

SEQ ID NO: 26396 - DNA, 31 bp, Artificial Sequence
  Primer
aaaaggcctccaacaagatttctcaagcacc

SEQ ID NO: 26397 - DNA, 31 bp, Artificial Sequence
  Primer
aaaaggcctccatacaatcctgaaagccaag

SEQ ID NO: 26398 - DNA, 32 bp, Artificial Sequence
  Primer
aaaaggcctcccatcatcatcagacaggtatc

SEQ ID NO: 26399 - DNA, 31 bp, Artificial Sequence
  Primer
aaaaggcctccctctattctcctcaagcacc

SEQ ID NO: 26400 - DNA, 31 bp, Artificial Sequence
  Primer
aaaaggcctccgaacaagatagcaaaggaac

SEQ ID NO: 26401 - DNA, 28 bp, Artificial Sequence
  Primer
aaaaggcctcctcaccgaaggtttcgtc

SEQ ID NO: 26402 - DNA, 31 bp, Artificial Sequence
  Primer
aaaaggcctcctccaggacattacctctgac

SEQ ID NO: 26403 - DNA, 30 bp, Artificial Sequence
  Primer
aaaaggcctcctgaaagccaagattgagtg

SEQ ID NO: 26404 - DNA, 30 bp, Artificial Sequence
  Primer
aaaaggcctcgaccttcatcaccattcatc

SEQ ID NO: 26405 - DNA, 31 bp, Artificial Sequence
  Primer
aaaaggcctcgatccatctctcctcctagtc

SEQ ID NO: 26406 - DNA, 31 bp, Artificial Sequence
  Primer
aaaaggcctcgcagtcaccataatgtgtacc

SEQ ID NO: 26407 - DNA, 34 bp, Artificial Sequence
  Primer
aaaaggcctctaacagggaacactacacttgctg

SEQ ID NO: 26408 - DNA, 35 bp, Artificial Sequence
  Primer
aaaaggcctctaatatgaaaggtgcgtgtttaacg

SEQ ID NO: 26409 - DNA, 34 bp, Artificial Sequence
  Primer
aaaaggcctctattcagcaagtgacacaaacatc

SEQ ID NO: 26410 - DNA, 31 bp, Artificial Sequence
  Primer
aaaaggcctctcaagcaccctaccaactacc

SEQ ID NO: 26411 - DNA, 30 bp, Artificial Sequence
  Primer
aaaaggcctctgtctgtcgccctcctagac

SEQ ID NO: 26412 - DNA, 31 bp, Artificial Sequence
  Primer
aaaaggcctcttcagggtacctccttcacag

SEQ ID NO: 26413 - DNA, 33 bp, Artificial Sequence
  Primer
aaaaggcctgacacttccttgaagaaccaattc

SEQ ID NO: 26414 - DNA, 31 bp, Artificial Sequence
  Primer
aaaaggcctgacataaggtcgttgaaacacg

SEQ ID NO: 26415 - DNA, 31 bp, Artificial Sequence
  Primer
aaaaggcctgcaataatacatcacggattgg

SEQ ID NO: 26416 - DNA, 31 bp, Artificial Sequence
  Primer
aaaaggcctgccctctagaccataacacacg

SEQ ID NO: 26417 - DNA, 30 bp, Artificial Sequence
  Primer
aaaaggcctgtcagcactcggcaatcttac

SEQ ID NO: 26418 - DNA, 31 bp, Artificial Sequence
  Primer
aaaaggcctgtctgttcacccattcagtttg

SEQ ID NO: 26419 - DNA, 31 bp, Artificial Sequence
  Primer
aaaaggcctgttccacgacatcaaacaacac

SEQ ID NO: 26420 - DNA, 31 bp, Artificial Sequence
  Primer
aaaaggccttaccatttctgcaggtttcacc

SEQ ID NO: 26421 - DNA, 31 bp, Artificial Sequence
  Primer
aaaaggccttcataagatgctgtcaagctgc

SEQ ID NO: 26422 - DNA, 31 bp, Artificial Sequence
  Primer
aaaaggccttcatattgacaagcttccgatg

SEQ ID NO: 26423 - DNA, 36 bp, Artificial Sequence
  Primer
aaaaggccttccactgaaattagtcttcattctttc

SEQ ID NO: 26424 - DNA, 31 bp, Artificial Sequence
  Primer
aaaaggccttccagagcgatatgttcctttc

SEQ ID NO: 26425 - DNA, 31 bp, Artificial Sequence
  Primer
aaaaggccttcttcagcaagttcattcctcc

SEQ ID NO: 26426 - DNA, 31 bp, Artificial Sequence
  Primer
aaaaggccttgaactcaatggacaatggaac

SEQ ID NO: 26427 - DNA, 32 bp, Artificial Sequence
  Primer
aaaaggccttgatgattgttatgcaatgaaag

SEQ ID NO: 26428 - DNA, 30 bp, Artificial Sequence
  Primer
aaaaggccttgcagcatggaaaccataatc

SEQ ID NO: 26429 - DNA, 30 bp, Artificial Sequence
  Primer
aaaaggccttgccagagccacacaataaac

SEQ ID NO: 26430 - DNA, 31 bp, Artificial Sequence
  Primer
aaaaggccttgctggaaatcatagcatcatc

SEQ ID NO: 26431 - DNA, 31 bp, Artificial Sequence
  Primer
aaaaggccttggtgctacaagtatcgagtgc

SEQ ID NO: 26432 - DNA, 32 bp, Artificial Sequence
  Primer
aaaaggccttggtttatgttgtgctagagtgc

SEQ ID NO: 26433 - DNA, 31 bp, Artificial Sequence
  Primer
aaaaggcctttacttacaaatgcgcgtgttc

SEQ ID NO: 26434 - DNA, 33 bp, Artificial Sequence
  Primer
aaaaggcctttataccaacactagccattctcg

SEQ ID NO: 26435 - DNA, 31 bp, Artificial Sequence
  Primer
aaaaggcctttccagctgttcatgtataagg

SEQ ID NO: 26436 - DNA, 31 bp, Artificial Sequence
  Primer
aaaaggcctttggcactgacacgatagaatc

SEQ ID NO: 26437 - DNA, 32 bp, Artificial Sequence
  Primer
aaacccgggaaacctttcgcatctgatacctc

SEQ ID NO: 26438 - DNA, 30 bp, Artificial Sequence
  Primer
aaacccgggaagcatccattccactccatc

SEQ ID NO: 26439 - DNA, 32 bp, Artificial Sequence
  Primer
aaacccgggaatctatggcggatgttgtacag

SEQ ID NO: 26440 - DNA, 32 bp, Artificial Sequence
  Primer
aaacccgggaatttattggcacagcacagaac

SEQ ID NO: 26441 - DNA, 31 bp, Artificial Sequence
  Primer
aaacccgggacctaaaacacacagtggctca

SEQ ID NO: 26442 - DNA, 31 bp, Artificial Sequence
  Primer
aaacccgggacgagctcatagacccaaggag

SEQ ID NO: 26443 - DNA, 31 bp, Artificial Sequence
  Primer
aaacccgggagcttggtggatacttggattg

SEQ ID NO: 26444 - DNA, 29 bp, Artificial Sequence
  Primer
aaacccgggattcgcagctaccagtttgg

SEQ ID NO: 26445 - DNA, 31 bp, Artificial Sequence
  Primer
aaacccgggatttgtgaaccatgttgaggtg

SEQ ID NO: 26446 - DNA, 33 bp, Artificial Sequence
  Primer
aaacccgggcaattcagttgaataacgatgacg

SEQ ID NO: 26447 - DNA, 31 bp, Artificial Sequence
  Primer
aaacccgggcacaactgacaccatcttctcc

SEQ ID NO: 26448 - DNA, 31 bp, Artificial Sequence
  Primer
aaacccgggcacgaagaagaaggagaagctg

SEQ ID NO: 26449 - DNA, 31 bp, Artificial Sequence
  Primer
aaacccgggcagttcatcactggtttgttgg

SEQ ID NO: 26450 - DNA, 35 bp, Artificial Sequence
  Primer
aaacccgggccaagaagatgttgtcatgttctgta

SEQ ID NO: 26451 - DNA, 29 bp, Artificial Sequence
  Primer
aaacccgggccataaaccctaaccgcagc

SEQ ID NO: 26452 - DNA, 24 bp, Artificial Sequence
  Primer
aaacccgggccgccatgccgaagc

SEQ ID NO: 26453 - DNA, 28 bp, Artificial Sequence
  Primer
aaacccgggccgcctcctcttctctcac

SEQ ID NO: 26454 - DNA, 27 bp, Artificial Sequence
  Primer
aaacccgggccgcctttgaattccacc

SEQ ID NO: 26455 - DNA, 27 bp, Artificial Sequence
  Primer
aaacccgggcctccgcttcgtctcctc

SEQ ID NO: 26456 - DNA, 31 bp, Artificial Sequence
  Primer
aaacccgggcctcctctcctctctctgtttc

SEQ ID NO: 26457 - DNA, 32 bp, Artificial Sequence
  Primer
aaacccgggcgaaccctaaccagtttcaaatc

SEQ ID NO: 26458 - DNA, 32 bp, Artificial Sequence
  Primer
aaacccgggcgattagcttggtggatacttgg

SEQ ID NO: 26459 - DNA, 29 bp, Artificial Sequence
  Primer
aaacccgggcgccaccaggcaagtagtag

SEQ ID NO: 26460 - DNA, 33 bp, Artificial Sequence
  Primer
aaacccgggctacagcacagaacaacagtttgc

SEQ ID NO: 26461 - DNA, 36 bp, Artificial Sequence
  Primer
aaacccgggctcagtcaagtacacctaatagaagca

SEQ ID NO: 26462 - DNA, 31 bp, Artificial Sequence
  Primer
aaacccgggctctcttttcccctccctttcc

SEQ ID NO: 26463 - DNA, 36 bp, Artificial Sequence
  Primer
aaacccgggcttcaatatacagagactggaaaggag

SEQ ID NO: 26464 - DNA, 31 bp, Artificial Sequence
  Primer
aaacccgggctttcgcatctgatacctcacc

SEQ ID NO: 26465 - DNA, 28 bp, Artificial Sequence
  Primer
aaacccggggacacccacttcgcatgac

SEQ ID NO: 26466 - DNA, 28 bp, Artificial Sequence
  Primer
aaacccggggcaacacggagaggttgag

SEQ ID NO: 26467 - DNA, 28 bp, Artificial Sequence
  Primer
aaacccggggccgccataaaccctaacc

SEQ ID NO: 26468 - DNA, 33 bp, Artificial Sequence
  Primer
aaacccggggcctagctatctatctatccaccg

SEQ ID NO: 26469 - DNA, 31 bp, Artificial Sequence
  Primer
aaacccggggcgaaagttgaaagttgaaacc

SEQ ID NO: 26470 - DNA, 31 bp, Artificial Sequence
  Primer
aaacccgggtaatcatgccgagtggtaaagc

SEQ ID NO: 26471 - DNA, 30 bp, Artificial Sequence
  Primer
aaacccgggtagccatgaagcctagcgttg

SEQ ID NO: 26472 - DNA, 31 bp, Artificial Sequence
  Primer
aaacccgggtcagaagcaacctaacatgtgg

SEQ ID NO: 26473 - DNA, 30 bp, Artificial Sequence
  Primer
aaacccgggtccagatggcaacctatgagc

SEQ ID NO: 26474 - DNA, 31 bp, Artificial Sequence
  Primer
aaacccgggtctcatgttcctcttcacaacg

SEQ ID NO: 26475 - DNA, 31 bp, Artificial Sequence
  Primer
aaacccgggtgcttctctggctcctaacatc

SEQ ID NO: 26476 - DNA, 31 bp, Artificial Sequence
  Primer
aaacccgggttgaaatctgcgacgaataacc

SEQ ID NO: 26477 - DNA, 31 bp, Artificial Sequence
  Primer
aaagaattcctacatcggtcaattgcgtgac

SEQ ID NO: 26478 - DNA, 32 bp, Artificial Sequence
  Primer
aaagaattcgaggtggctaaaagaagcacata

SEQ ID NO: 26479 - DNA, 36 bp, Artificial Sequence
  Primer
aaagaattcttagccgataaattagtcgagttgatc

SEQ ID NO: 26480 - DNA, 34 bp, Artificial Sequence
  Primer
aaagaattcttattagaaaggcatgatgtgggtg

SEQ ID NO: 26481 - DNA, 30 bp, Artificial Sequence
  Primer
aaagatatcgacagagacctgtgatggtgg

SEQ ID NO: 26482 - DNA, 31 bp, Artificial Sequence
  Primer
aaagatatcgagaaggagaagcagcagtagc

SEQ ID NO: 26483 - DNA, 31 bp, Artificial Sequence
  Primer
aaaggatccaaaccgcattccatatctcaac

SEQ ID NO: 26484 - DNA, 31 bp, Artificial Sequence
  Primer
aaaggatccaaagatcccaaaccctagcatc

SEQ ID NO: 26485 - DNA, 32 bp, Artificial Sequence
  Primer
aaaggatccaaatcccaatttctccttctgtc

SEQ ID NO: 26486 - DNA, 31 bp, Artificial Sequence
  Primer
aaaggatccaaatggagcttaccatctgagg

SEQ ID NO: 26487 - DNA, 33 bp, Artificial Sequence
  Primer
aaaggatccaacccaatttacgatcacaatctc

SEQ ID NO: 26488 - DNA, 29 bp, Artificial Sequence
  Primer
aaaggatccaaccctttcacctcccaatg

SEQ ID NO: 26489 - DNA, 33 bp, Artificial Sequence
  Primer
aaaggatccaacctctgccagtaccagtagttc

SEQ ID NO: 26490 - DNA, 33 bp, Artificial Sequence
  Primer
aaaggatccaacggataagagagggagaagttg

SEQ ID NO: 26491 - DNA, 29 bp, Artificial Sequence
  Primer
aaaggatccaactcaacgcgaaccagaac

SEQ ID NO: 26492 - DNA, 33 bp, Artificial Sequence
  Primer
aaaggatccaagaatagggttttgctatggaga

SEQ ID NO: 26493 - DNA, 27 bp, Artificial Sequence
  Primer
aaaggatccaagcgggagggagatgag

SEQ ID NO: 26494 - DNA, 31 bp, Artificial Sequence
  Primer
aaaggatccaagtaccggagcttatttgcag

SEQ ID NO: 26495 - DNA, 31 bp, Artificial Sequence
  Primer
aaaggatccaatagactgctccaaacccatc

SEQ ID NO: 26496 - DNA, 31 bp, Artificial Sequence
  Primer
aaaggatccaatcaaagccacgctcctaatc

SEQ ID NO: 26497 - DNA, 31 bp, Artificial Sequence
  Primer
aaaggatccaatcagaacaagacccaaatgc

SEQ ID NO: 26498 - DNA, 31 bp, Artificial Sequence
  Primer
aaaggatccaatccagaaggcgaagaagaag

SEQ ID NO: 26499 - DNA, 32 bp, Artificial Sequence
  Primer
aaaggatccaattatagccttcctcctcctcc

SEQ ID NO: 26500 - DNA, 31 bp, Artificial Sequence
  Primer
aaaggatccacaaataccagtaccgctccac

SEQ ID NO: 26501 - DNA, 26 bp, Artificial Sequence
  Primer
aaaggatccacacacgcccacacctc

SEQ ID NO: 26502 - DNA, 31 bp, Artificial Sequence
  Primer
aaaggatccaccacccgtctcctttaatttc

SEQ ID NO: 26503 - DNA, 30 bp, Artificial Sequence
  Primer
aaaggatccacccctcgtctgtctctcttc

SEQ ID NO: 26504 - DNA, 26 bp, Artificial Sequence
  Primer
aaaggatccacgcacaccaccaatgg

SEQ ID NO: 26505 - DNA, 32 bp, Artificial Sequence
  Primer
aaaggatccactgtagcaataattggtcgctc

SEQ ID NO: 26506 - DNA, 31 bp, Artificial Sequence
  Primer
aaaggatccagcctcctacacttaccgtcac

SEQ ID NO: 26507 - DNA, 30 bp, Artificial Sequence
  Primer
aaaggatccaggccgaggaacattaatctg

SEQ ID NO: 26508 - DNA, 30 bp, Artificial Sequence
  Primer
aaaggatccagtcagcggtggtgaaggtag

SEQ ID NO: 26509 - DNA, 27 bp, Artificial Sequence
  Primer
aaaggatccatcgccttcgagcatcag

SEQ ID NO: 26510 - DNA, 30 bp, Artificial Sequence
  Primer
aaaggatccattggaaatggagaaggcaag

SEQ ID NO: 26511 - DNA, 31 bp, Artificial Sequence
  Primer
aaaggatccatttcgactctcaactcccaag

SEQ ID NO: 26512 - DNA, 29 bp, Artificial Sequence
  Primer
aaaggatcccaacaataaaggcgggtgtc

SEQ ID NO: 26513 - DNA, 27 bp, Artificial Sequence
  Primer
aaaggatcccaacacacacgcccacac

SEQ ID NO: 26514 - DNA, 33 bp, Artificial Sequence
  Primer
aaaggatcccaaggttcaaagctcttgtctttc

SEQ ID NO: 26515 - DNA, 32 bp, Artificial Sequence
  Primer
aaaggatcccaagtagtggagttcgattcagg

SEQ ID NO: 26516 - DNA, 31 bp, Artificial Sequence
  Primer
aaaggatcccaatctccttgtggctagttcg

SEQ ID NO: 26517 - DNA, 33 bp, Artificial Sequence
  Primer
aaaggatcccaatttctccttctgtctttctgc

SEQ ID NO: 26518 - DNA, 31 bp, Artificial Sequence
  Primer
aaaggatcccaccaacacaatcctgtactcc

SEQ ID NO: 26519 - DNA, 31 bp, Artificial Sequence
  Primer
aaaggatcccactcagcgagttccgagttac

SEQ ID NO: 26520 - DNA, 31 bp, Artificial Sequence
  Primer
aaaggatcccactgctttgctctccagtctc

SEQ ID NO: 26521 - DNA, 31 bp, Artificial Sequence
  Primer
aaaggatcccagcgatccagagagaagctac

SEQ ID NO: 26522 - DNA, 32 bp, Artificial Sequence
  Primer
aaaggatcccagtccagcaagcaacaataaag

SEQ ID NO: 26523 - DNA, 31 bp, Artificial Sequence
  Primer
aaaggatcccatctgaggaaactcatcaagc

SEQ ID NO: 26524 - DNA, 31 bp, Artificial Sequence
  Primer
aaaggatcccatggtatgaacaggatcatcg

SEQ ID NO: 26525 - DNA, 31 bp, Artificial Sequence
  Primer
aaaggatcccattgagagaccgtggaaactc

SEQ ID NO: 26526 - DNA, 31 bp, Artificial Sequence
  Primer
aaaggatcccatttggcactcatacatttcg

SEQ ID NO: 26527 - DNA, 31 bp, Artificial Sequence
  Primer
aaaggatccccaatctccttgtggctagttc

SEQ ID NO: 26528 - DNA, 31 bp, Artificial Sequence
  Primer
aaaggatccccacaactatttcccttgcttg

SEQ ID NO: 26529 - DNA, 28 bp, Artificial Sequence
  Primer
aaaggatccccattgaaacgccagaatg

SEQ ID NO: 26530 - DNA, 30 bp, Artificial Sequence
  Primer
aaaggatccccattgttgcaacaccaagtg

SEQ ID NO: 26531 - DNA, 34 bp, Artificial Sequence
  Primer
aaaggatcccccttaaacaatcacttcactcttc

SEQ ID NO: 26532 - DNA, 30 bp, Artificial Sequence
  Primer
aaaggatccccgaaccctaactccatcttc

SEQ ID NO: 26533 - DNA, 29 bp, Artificial Sequence
  Primer
aaaggatccccgcactctcactgtgactc

SEQ ID NO: 26534 - DNA, 29 bp, Artificial Sequence
  Primer
aaaggatccccgccattataagagcgacc

SEQ ID NO: 26535 - DNA, 28 bp, Artificial Sequence
  Primer
aaaggatcccctccacctccacgtatgc

SEQ ID NO: 26536 - DNA, 31 bp, Artificial Sequence
  Primer
aaaggatcccctcctcatttcctctctcacc

SEQ ID NO: 26537 - DNA, 31 bp, Artificial Sequence
  Primer
aaaggatcccctctctcctgctagctacacc

SEQ ID NO: 26538 - DNA, 29 bp, Artificial Sequence
  Primer
aaaggatcccctggtgattattgcatgtg

SEQ ID NO: 26539 - DNA, 29 bp, Artificial Sequence
  Primer
aaaggatcccgaaaatgatggcagttggt

SEQ ID NO: 26540 - DNA, 30 bp, Artificial Sequence
  Primer
aaaggatcccgaaccctaactccatcttcc

SEQ ID NO: 26541 - DNA, 31 bp, Artificial Sequence
  Primer
aaaggatcccgaccaccatagcatcaaatac

SEQ ID NO: 26542 - DNA, 31 bp, Artificial Sequence
  Primer
aaaggatcccgatcacaatctcaaacacctc

SEQ ID NO: 26543 - DNA, 28 bp, Artificial Sequence
  Primer
aaaggatcccgatccaccattcctcctc

SEQ ID NO: 26544 - DNA, 29 bp, Artificial Sequence
  Primer
aaaggatcccggcggtgtaagagacagag

SEQ ID NO: 26545 - DNA, 30 bp, Artificial Sequence
  Primer
aaaggatcccgtataatgcagctgagccac

SEQ ID NO: 26546 - DNA, 29 bp, Artificial Sequence
  Primer
aaaggatccctaaaccctagccagccctc

SEQ ID NO: 26547 - DNA, 32 bp, Artificial Sequence
  Primer
aaaggatccctagctgcagatctcctcctctc

SEQ ID NO: 26548 - DNA, 34 bp, Artificial Sequence
  Primer
aaaggatccctatgcatgtggagtaacaaagagc

SEQ ID NO: 26549 - DNA, 29 bp, Artificial Sequence
  Primer
aaaggatccctcctattcggattcgccac

SEQ ID NO: 26550 - DNA, 28 bp, Artificial Sequence
  Primer
aaaggatccctcctctccgcgtcaaatc

SEQ ID NO: 26551 - DNA, 30 bp, Artificial Sequence
  Primer
aaaggatccctcttctcctctgtgcgactg

SEQ ID NO: 26552 - DNA, 31 bp, Artificial Sequence
  Primer
aaaggatccctgtgctgcttctaccatggac

SEQ ID NO: 26553 - DNA, 27 bp, Artificial Sequence
  Primer
aaaggatcccttcaatggcgactgtgc

SEQ ID NO: 26554 - DNA, 29 bp, Artificial Sequence
  Primer
aaaggatcccttccctcaccttccagagc

SEQ ID NO: 26555 - DNA, 31 bp, Artificial Sequence
  Primer
aaaggatcccttcgaagcttctcgcatctac

SEQ ID NO: 26556 - DNA, 30 bp, Artificial Sequence
  Primer
aaaggatccctttgctctccagtctccacc

SEQ ID NO: 26557 - DNA, 31 bp, Artificial Sequence
  Primer
aaaggatccgaaacgtttgttggtgatgaag

SEQ ID NO: 26558 - DNA, 30 bp, Artificial Sequence
  Primer
aaaggatccgaaattccatggcgctgtatc

SEQ ID NO: 26559 - DNA, 28 bp, Artificial Sequence
  Primer
aaaggatccgaaccgattcaacacgctg

SEQ ID NO: 26560 - DNA, 30 bp, Artificial Sequence
  Primer
aaaggatccgaacgcagcacacaggtagac

SEQ ID NO: 26561 - DNA, 31 bp, Artificial Sequence
  Primer
aaaggatccgaacgggttgtaataatcactg

SEQ ID NO: 26562 - DNA, 30 bp, Artificial Sequence
  Primer
aaaggatccgaagcaaatcgccattgaaac

SEQ ID NO: 26563 - DNA, 31 bp, Artificial Sequence
  Primer
aaaggatccgaagtctgatcgtctgagggtg

SEQ ID NO: 26564 - DNA, 31 bp, Artificial Sequence
  Primer
aaaggatccgaatcgaatcgaaagatgatgg

SEQ ID NO: 26565 - DNA, 30 bp, Artificial Sequence
  Primer
aaaggatccgacaatggcgtgctgaattac

SEQ ID NO: 26566 - DNA, 31 bp, Artificial Sequence
  Primer
aaaggatccgacactttctaattccggcaac

SEQ ID NO: 26567 - DNA, 30 bp, Artificial Sequence
  Primer
aaaggatccgaccaaacctctgccagtacc

SEQ ID NO: 26568 - DNA, 31 bp, Artificial Sequence
  Primer
aaaggatccgacccgttatcagagaatccag

SEQ ID NO: 26569 - DNA, 29 bp, Artificial Sequence
  Primer
aaaggatccgagaacactgtgctgtgctg

SEQ ID NO: 26570 - DNA, 33 bp, Artificial Sequence
  Primer
aaaggatccgaggcgatggagattttctactac

SEQ ID NO: 26571 - DNA, 30 bp, Artificial Sequence
  Primer
aaaggatccgagggagaagttgacagcgag

SEQ ID NO: 26572 - DNA, 32 bp, Artificial Sequence
  Primer
aaaggatccgatagagagagcgtgtgtgtttg

SEQ ID NO: 26573 - DNA, 29 bp, Artificial Sequence
  Primer
aaaggatccgatcaatggccctgctcaag

SEQ ID NO: 26574 - DNA, 29 bp, Artificial Sequence
  Primer
aaaggatccgatctcacctgacctcgtcg

SEQ ID NO: 26575 - DNA, 28 bp, Artificial Sequence
  Primer
aaaggatccgccaagatgacgggatttg

SEQ ID NO: 26576 - DNA, 29 bp, Artificial Sequence
  Primer
aaaggatccgccatcctcctcctcatttc

SEQ ID NO: 26577 - DNA, 30 bp, Artificial Sequence
  Primer
aaaggatccgccgtcgattcactcttaatg

SEQ ID NO: 26578 - DNA, 32 bp, Artificial Sequence
  Primer
aaaggatccgcctttacccgttgttcctttac

SEQ ID NO: 26579 - DNA, 30 bp, Artificial Sequence
  Primer
aaaggatccgcttttaccatccggttgttg

SEQ ID NO: 26580 - DNA, 29 bp, Artificial Sequence
  Primer
aaaggatccggcaacaggaatacagcagg

SEQ ID NO: 26581 - DNA, 31 bp, Artificial Sequence
  Primer
aaaggatccgggcaagaagagaagtgatagc

SEQ ID NO: 26582 - DNA, 28 bp, Artificial Sequence
  Primer
aaaggatccgggcaatggaggctagagc

SEQ ID NO: 26583 - DNA, 30 bp, Artificial Sequence
  Primer
aaaggatccgggttgcaagatttcttgttg

SEQ ID NO: 26584 - DNA, 29 bp, Artificial Sequence
  Primer
aaaggatccgtacgagaaatggcatgtcg

SEQ ID NO: 26585 - DNA, 34 bp, Artificial Sequence
  Primer
aaaggatccgtcactcatggactctcctctaatg

SEQ ID NO: 26586 - DNA, 29 bp, Artificial Sequence
  Primer
aaaggatccgtctccgtttctgcttctgc

SEQ ID NO: 26587 - DNA, 35 bp, Artificial Sequence
  Primer
aaaggatccgtgaaagtgtgagagaatgtctaacc

SEQ ID NO: 26588 - DNA, 29 bp, Artificial Sequence
  Primer
aaaggatccgtgactccgtgagcacactc

SEQ ID NO: 26589 - DNA, 31 bp, Artificial Sequence
  Primer
aaaggatccgtgtagcaagccaagaagaagc

SEQ ID NO: 26590 - DNA, 30 bp, Artificial Sequence
  Primer
aaaggatccgttaggagctgggtgactgac

SEQ ID NO: 26591 - DNA, 30 bp, Artificial Sequence
  Primer
aaaggatccgttagttattccgtgccgtcc

SEQ ID NO: 26592 - DNA, 35 bp, Artificial Sequence
  Primer
aaaggatccgttatgctagtttgtgtctggtcatc

SEQ ID NO: 26593 - DNA, 36 bp, Artificial Sequence
  Primer
aaaggatcctaaacaatcacttcactcttcaactcg

SEQ ID NO: 26594 - DNA, 36 bp, Artificial Sequence
  Primer
aaaggatcctaactcaaccttcttcaatcttcacac

SEQ ID NO: 26595 - DNA, 31 bp, Artificial Sequence
  Primer
aaaggatcctaccgctccactacttgattgc

SEQ ID NO: 26596 - DNA, 31 bp, Artificial Sequence
  Primer
aaaggatcctactacttggtgctccgtctcc

SEQ ID NO: 26597 - DNA, 31 bp, Artificial Sequence
  Primer
aaaggatcctatagcacttgtgggctctcag

SEQ ID NO: 26598 - DNA, 38 bp, Artificial Sequence
  Primer
aaaggatcctcaaccaatctgctaattgttaatcagtg

SEQ ID NO: 26599 - DNA, 33 bp, Artificial Sequence
  Primer
aaaggatcctcacttctactacagccactcacc

SEQ ID NO: 26600 - DNA, 31 bp, Artificial Sequence
  Primer
aaaggatcctcatttctttactgcggctagg

SEQ ID NO: 26601 - DNA, 31 bp, Artificial Sequence
  Primer
aaaggatcctccattcatcactgcaatcttc

SEQ ID NO: 26602 - DNA, 33 bp, Artificial Sequence
  Primer
aaaggatcctcccttccatcattactcttcttg

SEQ ID NO: 26603 - DNA, 31 bp, Artificial Sequence
  Primer
aaaggatcctccgcgaatctcatttctttac

SEQ ID NO: 26604 - DNA, 31 bp, Artificial Sequence
  Primer
aaaggatcctcctacacttaccgtcaccgac

SEQ ID NO: 26605 - DNA, 34 bp, Artificial Sequence
  Primer
aaaggatcctcctcaaatcaactccctttaagac

SEQ ID NO: 26606 - DNA, 32 bp, Artificial Sequence
  Primer
aaaggatcctcgacgttcactgtaactaatcg

SEQ ID NO: 26607 - DNA, 31 bp, Artificial Sequence
  Primer
aaaggatcctctcataccaaacacgcctttc

SEQ ID NO: 26608 - DNA, 36 bp, Artificial Sequence
  Primer
aaaggatcctcttcttcacttctactacagccactc

SEQ ID NO: 26609 - DNA, 30 bp, Artificial Sequence
  Primer
aaaggatcctgcatataccgaaaatgatgg

SEQ ID NO: 26610 - DNA, 30 bp, Artificial Sequence
  Primer
aaaggatcctgctatcgagggcaatagatg

SEQ ID NO: 26611 - DNA, 33 bp, Artificial Sequence
  Primer
aaaggatcctgggctctcagtacttggatttac

SEQ ID NO: 26612 - DNA, 31 bp, Artificial Sequence
  Primer
aaaggatcctggtacttatagccctgcaagc

SEQ ID NO: 26613 - DNA, 36 bp, Artificial Sequence
  Primer
aaaggatcctgtaatgtaaatacatgaaagctacca

SEQ ID NO: 26614 - DNA, 36 bp, Artificial Sequence
  Primer
aaaggatcctgtactacaattcctcaaatcaactcc

SEQ ID NO: 26615 - DNA, 31 bp, Artificial Sequence
  Primer
aaaggatcctgttctcttgtttctgccactc

SEQ ID NO: 26616 - DNA, 33 bp, Artificial Sequence
  Primer
aaaggatccttaattccgtttctcacatctcac

SEQ ID NO: 26617 - DNA, 32 bp, Artificial Sequence
  Primer
aaaggatccttatacccaaacaggcctttacc

SEQ ID NO: 26618 - DNA, 32 bp, Artificial Sequence
  Primer
aaaggatccttccctcacttcctaaacacacc

SEQ ID NO: 26619 - DNA, 35 bp, Artificial Sequence
  Primer
aaaggatccttcctttaactcaaccttcttcaatc

SEQ ID NO: 26620 - DNA, 36 bp, Artificial Sequence
  Primer
aaaggatccttctcaaatcacaaaattaacctattc

SEQ ID NO: 26621 - DNA, 30 bp, Artificial Sequence
  Primer
aaaggatccttgagcacttgggtaaagacg

SEQ ID NO: 26622 - DNA, 31 bp, Artificial Sequence
  Primer
aaaggtaccaaatacagtggagcctgagtgg

SEQ ID NO: 26623 - DNA, 31 bp, Artificial Sequence
  Primer
aaaggtaccaactgatcgacagcactcacag

SEQ ID NO: 26624 - DNA, 33 bp, Artificial Sequence
  Primer
aaaggtaccataaatctactagccggaacttca

SEQ ID NO: 26625 - DNA, 30 bp, Artificial Sequence
  Primer
aaaggtaccatcaccaccgaggaacttcac

SEQ ID NO: 26626 - DNA, 31 bp, Artificial Sequence
  Primer
aaaggtaccatgctagtttctgggctgactg

SEQ ID NO: 26627 - DNA, 31 bp, Artificial Sequence
  Primer
aaaggtaccatggaaatcataccagcgaaac

SEQ ID NO: 26628 - DNA, 31 bp, Artificial Sequence
  Primer
aaaggtaccattcacactgcaacaggaaacc

SEQ ID NO: 26629 - DNA, 31 bp, Artificial Sequence
  Primer
aaaggtacccaaccggcgaatatacaagatg

SEQ ID NO: 26630 - DNA, 35 bp, Artificial Sequence
  Primer
aaaggtacccaactctaatatgtggaaggcatagt

SEQ ID NO: 26631 - DNA, 31 bp, Artificial Sequence
  Primer
aaaggtacccaattcaccatcaccatgtttc

SEQ ID NO: 26632 - DNA, 36 bp, Artificial Sequence
  Primer
aaaggtacccacataggactattcaactagaccacc

SEQ ID NO: 26633 - DNA, 34 bp, Artificial Sequence
  misc_feature (12)..(12): n is a, c, g, or t
  misc_feature (15)..(15): n is a, c, g, or t
  Primer
aaaggtacccanccnctctttcggaataaatagc

SEQ ID NO: 26634 - DNA, 31 bp, Artificial Sequence
  Primer
aaaggtacccattacatttgcatgttgctcc

SEQ ID NO: 26635 - DNA, 33 bp, Artificial Sequence
  Primer
aaaggtaccccaacgaatcaacatatttgaaag

SEQ ID NO: 26636 - DNA, 35 bp, Artificial Sequence
  Primer
aaaggtaccccaagcatcacataggactattcaac

SEQ ID NO: 26637 - DNA, 29 bp, Artificial Sequence
  Primer
aaaggtaccccctgcagtagaagaggagg

SEQ ID NO: 26638 - DNA, 33 bp, Artificial Sequence
  misc_feature (28)..(28): n is a, c, g, or t
  Primer
aaaggtacccggaataaatagcatctcnggttg

SEQ ID NO: 26639 - DNA, 32 bp, Artificial Sequence
  Primer
aaaggtacccgtgctttacgaaattcacaatc

SEQ ID NO: 26640 - DNA, 31 bp, Artificial Sequence
  Primer
aaaggtaccctactgctaaccacccatcacc

SEQ ID NO: 26641 - DNA, 36 bp, Artificial Sequence
  Primer
aaaggtaccctatatggaatgaggtaaaggagatgc

SEQ ID NO: 26642 - DNA, 35 bp, Artificial Sequence
  Primer
aaaggtaccgactagtcacaaactgcagaaagatg

SEQ ID NO: 26643 - DNA, 32 bp, Artificial Sequence
  Primer
aaaggtaccgcagaaagatgtatttccagtcg

SEQ ID NO: 26644 - DNA, 34 bp, Artificial Sequence
  Primer
aaaggtacctagcattacccaattggaaatagag

SEQ ID NO: 26645 - DNA, 33 bp, Artificial Sequence
  Primer
aaaggtacctcattacgagcggttaaggtaagc

SEQ ID NO: 26646 - DNA, 31 bp, Artificial Sequence
  Primer
aaaggtacctccaattctccaacgaatcaac

SEQ ID NO: 26647 - DNA, 35 bp, Artificial Sequence
  Primer
aaaggtaccttgaatgacgagagtaatacaaaacc

SEQ ID NO: 26648 - DNA, 27 bp, Artificial Sequence
  Primer
aaagtcgacaaacattcgcgtgattcc

SEQ ID NO: 26649 - DNA, 31 bp, Artificial Sequence
  Primer
aaagtcgacaactcaaaccgtcaaacgtgtc

SEQ ID NO: 26650 - DNA, 31 bp, Artificial Sequence
  Primer
aaagtcgacacagcaccgcacagtgtagtag

SEQ ID NO: 26651 - DNA, 27 bp, Artificial Sequence
  Primer
aaagtcgacacccaccaccatcaaacg

SEQ ID NO: 26652 - DNA, 30 bp, Artificial Sequence
  Primer
aaagtcgacagcaaccttcttctccactcc

SEQ ID NO: 26653 - DNA, 31 bp, Artificial Sequence
  Primer
aaagtcgaccagaagggaggaagtgacattg

SEQ ID NO: 26654 - DNA, 31 bp, Artificial Sequence
  Primer
aaagtcgaccatttcttcattgctggaagtg

SEQ ID NO: 26655 - DNA, 31 bp, Artificial Sequence
  Primer
aaagtcgaccgagggaaaagaagtgaaaacc

SEQ ID NO: 26656 - DNA, 31 bp, Artificial Sequence
  Primer
aaagtcgaccgatagtcagattgtgctgtgc

SEQ ID NO: 26657 - DNA, 25 bp, Artificial Sequence
  Primer
aaagtcgaccggagatggacacgcc

SEQ ID NO: 26658 - DNA, 28 bp, Artificial Sequence
  Primer
aaagtcgaccgtcaaacgtgtccaatcc

SEQ ID NO: 26659 - DNA, 31 bp, Artificial Sequence
  Primer
aaagtcgacctaaaccctacttcaccggagc

SEQ ID NO: 26660 - DNA, 25 bp, Artificial Sequence
  Primer
aaagtcgacctcggacgcagtgcag

SEQ ID NO: 26661 - DNA, 31 bp, Artificial Sequence
  Primer
aaagtcgaccttacaaatcccatccatccac

SEQ ID NO: 26662 - DNA, 34 bp, Artificial Sequence
  Primer
aaagtcgaccttcttactgctcaaggtttcaagg

SEQ ID NO: 26663 - DNA, 31 bp, Artificial Sequence
  Primer
aaagtcgacgaagacaatgtcagcttcggag

SEQ ID NO: 26664 - DNA, 31 bp, Artificial Sequence
  Primer
aaagtcgacgaggaggaggacaagttcactg

SEQ ID NO: 26665 - DNA, 34 bp, Artificial Sequence
  Primer
aaagtcgacgataaggagagcagagggagtctac

SEQ ID NO: 26666 - DNA, 34 bp, Artificial Sequence
  Primer
aaagtcgacgatcacaaacatgtcagatatcagg

SEQ ID NO: 26667 - DNA, 29 bp, Artificial Sequence
  Primer
aaagtcgacggaaaggagaggatgggatt

SEQ ID NO: 26668 - DNA, 28 bp, Artificial Sequence
  Primer
aaagtcgacgtcggagagcttgaggtgg

SEQ ID NO: 26669 - DNA, 31 bp, Artificial Sequence
  Primer
aaagtcgacgtttactgttgccatggtgttg

SEQ ID NO: 26670 - DNA, 31 bp, Artificial Sequence
  Primer
aaagtcgactataagccctgtttggaccatc

SEQ ID NO: 26671 - DNA, 31 bp, Artificial Sequence
  Primer
aaagtcgactccattgatccgagaagctaag

SEQ ID NO: 26672 - DNA, 33 bp, Artificial Sequence
  Primer
aaagtcgactcctcacatagagaagttcacagc

SEQ ID NO: 26673 - DNA, 32 bp, Artificial Sequence
  Primer
aaagtcgactggaaaagaaacattctggtgtg

SEQ ID NO: 26674 - DNA, 27 bp, Artificial Sequence
  Primer
aaagtcgactggaaatggcagagcagc

SEQ ID NO: 26675 - DNA, 31 bp, Artificial Sequence
  Primer
ataggatccagaaacctttcaccaacactgc

SEQ ID NO: 26676 - DNA, 31 bp, Artificial Sequence
  Primer
ataggatcctcttcaccttcgcatcagaaac

SEQ ID NO: 26677 - DNA, 30 bp, Artificial Sequence
  Primer
tttaggcctcacatgcaattcatacgtgtc

SEQ ID NO: 26678 - DNA, 33 bp, Artificial Sequence
  Primer
tttaggcctctagatgttggagttgttgggttg

SEQ ID NO: 26679 - DNA, 34 bp, Artificial Sequence
  Primer
tttaggcctgctggatttcagtcgtctgatatac

SEQ ID NO: 26680 - DNA, 29 bp, Artificial Sequence
  Primer
tttaggccttcagcagcatcacagcttct

SEQ ID NO: 26681 - DNA, 30 bp, Artificial Sequence
  Primer
tttcccgggcccagcctccaaagtcactag

SEQ ID NO: 26682 - DNA, 28 bp, Artificial Sequence
  Primer
tttcccgggggtaccctgcaatggatgc

SEQ ID NO: 26683 - DNA, 33 bp, Artificial Sequence
  Primer
tttcccgggtcatcatgtggagtctctcttcgg

SEQ ID NO: 26684 - DNA, 34 bp, Artificial Sequence
  Primer
tttcccgggtcattaaagtgcaacaaatcatctc

SEQ ID NO: 26685 - DNA, 34 bp, Artificial Sequence
  Primer
tttcccgggtcattccgtagcctgataatgatgc

SEQ ID NO: 26686 - DNA, 31 bp, Artificial Sequence
  Primer
tttcccgggtgacttgctgattggtggttag

SEQ ID NO: 26687 - DNA, 39 bp, Artificial Sequence
  Primer
tttcccgggttaggattcttacaatgatttgaattgctc

SEQ ID NO: 26688 - DNA, 30 bp, Artificial Sequence
  Primer
tttctcgagacgcaaaagaactgcttgctc

SEQ ID NO: 26689 - DNA, 35 bp, Artificial Sequence
  Primer
tttctcgagagctgtagaagcatctgttgacatag

SEQ ID NO: 26690 - DNA, 29 bp, Artificial Sequence
  Primer
tttctcgagcagggacttggcacgaagat

SEQ ID NO: 26691 - DNA, 34 bp, Artificial Sequence
  Primer
tttctcgagccactactgatcttacatgttgagc

SEQ ID NO: 26692 - DNA, 33 bp, Artificial Sequence
  Primer
tttctcgagctactagagatgccacaccaatgc

SEQ ID NO: 26693 - DNA, 30 bp, Artificial Sequence
  Primer
tttgaattcacacgggatgctagtgctacc

SEQ ID NO: 26694 - DNA, 31 bp, Artificial Sequence
  Primer
tttgaattcccactggtgtattttaccgctg

SEQ ID NO: 26695 - DNA, 34 bp, Artificial Sequence
  Primer
tttgaattcccagctcaatccttagctatattcc

SEQ ID NO: 26696 - DNA, 35 bp, Artificial Sequence
  Primer
tttgaattccctgtgtcacatgaatcctcaattag

SEQ ID NO: 26697 - DNA, 30 bp, Artificial Sequence
  Primer
tttgaattcctacaacgcttccatgttcca

SEQ ID NO: 26698 - DNA, 33 bp, Artificial Sequence
  Primer
tttgaattcctactacaaggcctttgtccttcg

SEQ ID NO: 26699 - DNA, 35 bp, Artificial Sequence
  Primer
tttgaattcctagagttcatgtcagtcttcgaagg

SEQ ID NO: 26700 - DNA, 36 bp, Artificial Sequence
  Primer
tttgaattcctaggctatagctagctatgcttgttg

SEQ ID NO: 26701 - DNA, 37 bp, Artificial Sequence
  Primer
tttgaattcctcaaagcaacctataacatcattaagc

SEQ ID NO: 26702 - DNA, 32 bp, Artificial Sequence
  Primer
tttgaattcctgaactctcaactctgcagtgc

SEQ ID NO: 26703 - DNA, 35 bp, Artificial Sequence
  Primer
tttgaattcctgtcaagtaaacagagtttgactgg

SEQ ID NO: 26704 - DNA, 29 bp, Artificial Sequence
  Primer
tttgaattcgcaacggaaggctacatgac

SEQ ID NO: 26705 - DNA, 32 bp, Artificial Sequence
  Primer
tttgaattcgcagaagtggttctagagatgcc

SEQ ID NO: 26706 - DNA, 33 bp, Artificial Sequence
  Primer
tttgaattcgcgaacacagcatcttacatacag

SEQ ID NO: 26707 - DNA, 34 bp, Artificial Sequence
  Primer
tttgaattcggtcaatctgcatcagttgtacatg

SEQ ID NO: 26708 - DNA, 33 bp, Artificial Sequence
  Primer
tttgaattctcagtgtcagccggctatgaacac

SEQ ID NO: 26709 - DNA, 32 bp, Artificial Sequence
  Primer
tttgaattctcatcacgagtccatgtccacag

SEQ ID NO: 26710 - DNA, 36 bp, Artificial Sequence
  Primer
tttgaattcttaccgttaattctggctgtagtatgg

SEQ ID NO: 26711 - DNA, 36 bp, Artificial Sequence
  Primer
tttgaattcttagacttcacagctttaagatggtcc

SEQ ID NO: 26712 - DNA, 33 bp, Artificial Sequence
  Primer
tttgaattcttatgctgaagacaatgcagaagc

SEQ ID NO: 26713 - DNA, 33 bp, Artificial Sequence
  Primer
tttgatatcccacgttattgctattgtttgttg

SEQ ID NO: 26714 - DNA, 37 bp, Artificial Sequence
  Primer
tttggatccgtttgcagtattcactcagtatacaagg

SEQ ID NO: 26715 - DNA, 32 bp, Artificial Sequence
  Primer
tttggatcctatcttttccctccctcctctgt

SEQ ID NO: 26716 - DNA, 31 bp, Artificial Sequence
  Primer
tttggatccttacaagttagaaatggcgagc

SEQ ID NO: 26717 - DNA, 31 bp, Artificial Sequence
  Primer
tttggtaccaaggatcagagaattggattcc

SEQ ID NO: 26718 - DNA, 32 bp, Artificial Sequence
  Primer
tttggtaccattctcaacacatacctttcgac

SEQ ID NO: 26719 - DNA, 35 bp, Artificial Sequence
  Primer
tttggtaccctaaatccactaccaaatactcctcg

SEQ ID NO: 26720 - DNA, 32 bp, Artificial Sequence
  Primer
tttggtaccgagctgctggtacatatttgagc

SEQ ID NO: 26721 - DNA, 28 bp, Artificial Sequence
  Primer
tttggtaccggagagagctcaccgaagc

SEQ ID NO: 26722 - DNA, 31 bp, Artificial Sequence
  Primer
tttggtaccttattattgcacaagctccggc

SEQ ID NO: 26723 - DNA, 33 bp, Artificial Sequence
  Primer
tttgtcgacacagtgtagtagttgcacctaggc

SEQ ID NO: 26724 - DNA, 31 bp, Artificial Sequence
  Primer
tttgtcgacatttttctggctctttctgagg

SEQ ID NO: 26725 - DNA, 32 bp, Artificial Sequence
  Primer
tttttctcgagcataagcagaagcaacacgtg

SEQ ID NO: 26726 - DNA, 35 bp, Artificial Sequence
  Primer
tttttctcgagtcatgtccaagctggttaaaatgg

SEQ ID NO: 26727 - DNA, 37 bp, Artificial Sequence
  Primer
tttttgaattctcaatctgattcgctcccgattctgt

SEQ ID NO: 26728 - DNA, 35 bp, Artificial Sequence
  Primer
tttttgaattcttattaaggatttagcggctcgtc

SEQ ID NO: 26729 - DNA, 20 bp, 5prime gRNA
agatgcattgatctcgcgcg

SEQ ID NO: 26730 - DNA, 20 bp, 3prime gRNA
atttgccaaagtattccggg

SEQ ID NO: 26731 - DNA, 1000 bp, Zea mays
  Upstream flanking region
taacacaagtgtcgaataggaaattcacgagctgtcaaaaaccacatgaggtttgtttttgacccgcgaccgcgagcttgctaacgcaaggtttcagttctcgccgaaacgaaacaaaatgacggtgccgcgcttgcgctgtcatttttttgttttcgacggccaggctgaaactgtatggctgaggatgtcactgagcttcttgtttcctagtgaaaatggtagagagcagttacttgttcacgtgagagaagaaactaaagagaaaataaattagcctttctgcctttgtgactgttttgaacttttgatatatatatccagccttccgcatgctatatttgaatctcaataaacggtgctaggggggttttagcaaaagtacttcaatgttcaatactgtcttaatagacgtccttctctaacatcaaggagtacattgcgtacgggccctatttatttcggtttttggctgttagaatcggcttttggcagccaaatattttgtttttcagattgcttacatgagaatcgcgtctgtaaaaatcgtctaaatcaacgttaatataaaatcctaaattgtgcagagccctccacctttcttaacacacaacacaggtctcaggatattcaaatccatataagagctagattattcagtagtccagattccgaccaaaactctttaggatgctatcacaaacaaacatgtccatattctttcgtgattttaacgtatcgttttcgtgccctctaaccaaaacactcccaaacttgttttcgcttttcgaaaggaggctcgaaattatgaaactaaattttaggaataaagacacaattgcgacacaaaaataacctttttttacccaacttcacaccaccatatgtaggtcttcgtgctaccggatttgccaacacctataaaatttatgtcaggttgtcacggctttactattatcgcgtctaacttcaaacacatctggagatgcattgatctcgc

SEQ ID NO: 26732 - DNA, 1000 bp, Zea mays
  Downstream flanking region
ggaatactttggcaaattctgctctgtccttgcaaccaagcataacatacaagtgaccgaaatagacaagcaaagtatatcagaacattgtcaaattgcaagttgcaacaaaactgaagcaaacacaatgtagaaaccattcggagcatcacaggggttggtagcaatctgagatacatgattaaaggaatggtttaatagtacatgcacaattaaatgtttctttttgtttccaagctaggctatgaattgtccacgatcaagctaaaaccccctacccactaaacaggagactgctaggcaggggcgaacagggagcattcctgcatgtaagcaaccagccaaccaaatcacagccatctatcatttcctcttcttagtaggtggttgggggacatcatcgtcatcatcctcttcctcttcttcctcctcatcttcctcattgtcaccatccccatcatcatcgtcgtcatcatcctcctcttcatcctctccaccatcatcatcgtcgtcacttcctccttcaccgttggctgcaggatcgttatcatcgtcgtcgtcatcttcctcctcattcccattgtcatctgatccctcatcaccaccatcatcttcttggttttcagcatcctcatcgtctccctcctcatcattatcatcatcagactctccatcatccttgttctcgaaatcagttgcatttttgtttttgctcagaatccttgtggagaaggaaacaaacaatcctcagctttgggagacgaaaaaaaatgcccatggcaataatgatgtggtacatgttttgacattatgcaccagtgggcattacctattaatcaaattctgatctccaccagatgtaaagatttcattatgaagaatctgcacaagaaagtcaaaacagtacacagtattagctaagacgaggtatatttccaattaaaagtgcacgaacaatgcaacaatggttattcccgggctttaaaggacataagacacg

SEQ ID NO: 26733 - DNA, 17 bp, Zea mays
  5prime gRNA after cut
agatgcattgatctcgc

SEQ ID NO: 26734 - DNA, 17 bp, Zea mays
  3prime gRNA after cut
ggaatactttggcaaat

SEQ ID NO: 26735 - DNA, 6402 bp, Artificial Sequence
  Complete repair construct
taacacaagtgtcgaataggaaattcacgagctgtcaaaaaccacatgaggtttgtttttgacccgcgaccgcgagcttgctaacgcaaggtttcagttctcgccgaaacgaaacaaaatgacggtgccgcgcttgcgctgtcatttttttgttttcgacggccaggctgaaactgtatggctgaggatgtcactgagcttcttgtttcctagtgaaaatggtagagagcagttacttgttcacgtgagagaagaaactaaagagaaaataaattagcctttctgcctttgtgactgttttgaacttttgatatatatatccagccttccgcatgctatatttgaatctcaataaacggtgctaggggggttttagcaaaagtacttcaatgttcaatactgtcttaatagacgtccttctctaacatcaaggagtacattgcgtacgggccctatttatttcggtttttggctgttagaatcggcttttggcagccaaatattttgtttttcagattgcttacatgagaatcgcgtctgtaaaaatcgtctaaatcaacgttaatataaaatcctaaattgtgcagagccctccacctttcttaacacacaacacaggtctcaggatattcaaatccatataagagctagattattcagtagtccagattccgaccaaaactctttaggatgctatcacaaacaaacatgtccatattctttcgtgattttaacgtatcgttttcgtgccctctaaccaaaacactcccaaacttgttttcgcttttcgaaaggaggctcgaaattatgaaactaaattttaggaataaagacacaattgcgacacaaaaataacctttttttacccaacttcacaccaccatatgtaggtcttcgtgctaccggatttgccaacacctataaaatttatgtcaggttgtcacggctttactattatcgcgtctaacttcaaacacatctggagatgcattgatctcgcgcgcttgaaaatttagttattaggttggtaaaagactaggttaggtaagaaatttgaaaacaaaaatccatgggagatgtttttacgtagaagaatagtgagaatttgagaaactttatttcctaagaaacaaagaaagttttggtgaaataattgaaacgaaaaattcgagaaactagaagcccgataatgcccttctcctctaccaactaccagcgcagtcactcgcctctgcacacgtcgctgatgctcgtcttccttccttcccatcctttataaggcccggccgcggctctgctcgcctctcctcccttccctcccgtaccgtatcagtctcccggattctctccggttcgtgggagggccaaagcttcgagttaggaaaaccctaccgctgtgggagtagcctccggcgatggcgccctctgccgctgccccaggcatctctgaggctgagggggcaccacgcatggccaagttcctctgcagctttggaggtagtatccttccccgaccacttgatggctgtcttcgatatgttggtggcgagacaaggattgtcatattgccgcgtgacatatcatatgccgacctagctgcacggatgagagatctctacaaggatgctgataccatcaaataccagcaacctgatgaggatctggatgcgctggtctcggtcgtgaatcacgatgatgtggtgaacatgatggaggagtatgacaaagtcactgccacaggggaggcgttcactcggctcaggatcttcttattttctcagcaattggatgacaatgctgcatcagtggctgtgcattacaatgtagacgagcgggaaacagagagaaggtatgtagatgcgctcaacagccttggtgatgttaggtcaccttcctcccctgtatctgtggagcagctttttggcatcggaggcaatgattcaggaattcctgattttgctggcttgagacatttgaatgtccctcgtccatcacatggtcagaggtatggagagatggattctccttggagccctgcttatgtctcaccaagccagtacagagtgcatgacccgagggattttccaatttcaccgtcatctgcaaggttccaagtaggagcggaggattttgatgacaggattcctgacgactttgtaaggcagtcaccaaaatatcattattatgaggctcaatcaccatcacatatggataatttagtctggcttccacctggtgctgtaattcagcaaaatgcaggtttccctggtgatttgagcaagcacaataaatttttggatgggaacagtggatgtgatcactgtggttcactattccacaagggtcagggttcggtgactgatcctatctatatgaatcctcgttggactcggccagtccaacaacattttgaccaaccaagcatgattaatgattatcccggtcaccatgctaattcttgtccagattactgccgccctggtgagcattatgcgggaggtcaagatgttagattggaaaatggtgtttatgttaaagagcaaaatggtggtcatactcccatgctttataatgagtcacgtcctcacgatagagtctggtatgcgcataccaaccaaagtcatcagcggtatgaggatccaaggctgcattatcctactaatgatagagtgatcgagccatacattgtcgatgctagctctgtaaattccgcatttgcaccaaacaaagtatatgaaatgcattcagcatctcttggtcattctagttctagccatgaaagtcctcactattttcatggtagcagtgagctcataaatgacgcatatcacaaccaacaagttggaggcagtgggtcatatgtgcagccagcagggtctgaagaatcccctggtcagcattacaaccacttttcggcctatggtgcagattccttttatcaaatgcaacaaaatttgccacccattcaatctttgaggaggagagcgaacagtcctgttcacactgcctcaccatatgattccccacacctgccaataccaaatgggagcattaacatgaattctgttagaaatacaggtgatgcgagtcccaggatagcaggtcttattggatatgatcgaatgccaaacccatttactccgcccaatggcagcatactatatagagttggtgggcatgatgttcctgcagctatggagaacactagtgcttttggtcctaggtctaatccaactgctgctcagtatgttcagccttttattgctcctgaatcaatccagcatcaacctggagttcccttgagggaggtttatcctgaaagagcataccctgaacccatgccgtcatcatatgctgatggcaaagtagctgtttctgcattgcccctcaccgaccaattattcaggttggatataaacacaatgaagaaacttgaaggacaagatgatgggaactctactcgaaatgtgaatgaaacaactcttttgcatgctgtggatgaaccaagtaccttaccccaccatgttggatctgtacatgaagtcgatcctaagcaggagaagctaaccgaaaaagaaagcaggcaaaagcaacatgaagctggggctacagcactgcaggaatgtgaggatatttcagaggatatgttgaatttccttcctgaattaattgcctctgttaaaaaggtaacactggaagatgctgctgagacacaaatagcccaatcagatgctaatgctgctgtttcacctgttcctgatgatgacgataatggaaagaagctggatgaggcaacagctggtaatacaaatgcaaatcaggaccttgatttgcaaggaagccttgatcggcagaagagtttcaagattgagtctacaactgctgaagctgaagctttgtcgaaaggactacagactataaaaaatgatgatttagaggaaattagagagctgggttcaggtacttatggggcggtctatcatggtaaatggaggggatgcgatgttgctattaaaagaataaaagcaagttgctttgctggaagaccatctgaaagagagcgtttgatcacggatttctggaaagaagctctgatcctaagctcacttcatcatccaaatgtggttgcattttatggtgtagttcgtgatggtccagatggaagcttagcaactgttactgagtttatggttaatgggtctctcaaacagttcctgaggaaaaaagacaggacaatagatcgccggaagagagtaatattagccatggatgctgcatttggcatggaatatttgcacgggaagaatatagtccattttgacctgaagtgtgagaatctactggtgaacatgagggatccacagcgaccaatctgcaagatcggtgatctcgggctatcaaaggttaaacagcatactttggtatctggtggtgttagaggaaccttaccgtggatggcaccagagcttctgagtgggaaaaacaatatggtgtcagagaagattgacgtctattcgtttggaattgtcatgtgggagctgcttactggggaagagccatactctgatatgcgtgctgctgaaattattggggccattgtaaacgattccttacgccctcaaatcccttcatggtgtgatcctgagtggaagggattgatggaaagctgttggtccagtgatccagcggagagaccgtccttcactgatatatctcaaaggttgaggaaaatggccgctgcaatgaatgtgaagtgagccagcgagagacgcaggataaaggccgtagttttgcaaggcgagtagagcagtatgtcagtaatacagcatctatggcatgtgcttttgctcgtccagttcatgagccccgttgtgtatttggtttccgttttcttggttggagtttttagttccaaggtccgatcatgttttgatcccataaattctcttccagccttcgagcaactgagtccatcttcctaagtcatcagccccagcgagacattgaagcatggggaaacttaaacagtatggtgatgattaatctcagcattttttttcttgcagcaatcaatatggactttgcttaaaatttcgttgtcttttcaaaacgatatgcaagcaaaatggaagtgatgttctttgaaactttgtttcaatgctatagcaaaggtttgcattttacaaagttcggtttagtgacgaccatttagatgacatagattatgcttttcgtattttggtagcttctcgtgcggacgcgcggtcatgcctagcatgccgaagaccttgtcatatagtgaaaggaattgcggtagcaattagttcatttttccctaatcccctccaatcactttctcaccaaacaaactccaaaggtcgtcaccgaagggggacgttcccggaatactttggcaaattctgctctgtccttgcaaccaagcataacatacaagtgaccgaaatagacaagcaaagtatatcagaacattgtcaaattgcaagttgcaacaaaactgaagcaaacacaatgtagaaaccattcggagcatcacaggggttggtagcaatctgagatacatgattaaaggaatggtttaatagtacatgcacaattaaatgtttctttttgtttccaagctaggctatgaattgtccacgatcaagctaaaaccccctacccactaaacaggagactgctaggcaggggcgaacagggagcattcctgcatgtaagcaaccagccaaccaaatcacagccatctatcatttcctcttcttagtaggtggttgggggacatcatcgtcatcatcctcttcctcttcttcctcctcatcttcctcattgtcaccatccccatcatcatcgtcgtcatcatcctcctcttcatcctctccaccatcatcatcgtcgtcacttcctccttcaccgttggctgcaggatcgttatcatcgtcgtcgtcatcttcctcctcattcccattgtcatctgatccctcatcaccaccatcatcttcttggttttcagcatcctcatcgtctccctcctcatcattatcatcatcagactctccatcatccttgttctcgaaatcagttgcatttttgtttttgctcagaatccttgtggagaaggaaacaaacaatcctcagctttgggagacgaaaaaaaatgcccatggcaataatgatgtggtacatgttttgacattatgcaccagtgggcattacctattaatcaaattctgatctccaccagatgtaaagatttcattatgaagaatctgcacaagaaagtcaaaacagtacacagtattagctaagacgaggtatatttccaattaaaagtgcacgaacaatgcaacaatggttattcccgggctttaaaggacataagacacg

SEQ ID NO: 26736 - DNA, 3342 bp, Zea mays
  Cloned gene CDS
atggcgccctctgccgctgccccaggcatctctgaggctgagggggcaccacgcatggccaagttcctctgcagctttggaggtagtatccttccccgaccacttgatggctgtcttcgatatgttggtggcgagacaaggattgtcatattgccgcgtgacatatcatatgccgacctagctgcacggatgagagatctctacaaggatgctgataccatcaaataccagcaacctgatgaggatctggatgcgctggtctcggtcgtgaatcacgatgatgtggtgaacatgatggaggagtatgacaaagtcactgccacaggggaggcgttcactcggctcaggatcttcttattttctcagcaattggatgacaatgctgcatcagtggctgtgcattacaatgtagacgagcgggaaacagagagaaggtatgtagatgcgctcaacagccttggtgatgttaggtcaccttcctcccctgtatctgtggagcagctttttggcatcggaggcaatgattcaggaattcctgattttgctggcttgagacatttgaatgtccctcgtccatcacatggtcagaggtatggagagatggattctccttggagccctgcttatgtctcaccaagccagtacagagtgcatgacccgagggattttccaatttcaccgtcatctgcaaggttccaagtaggagcggaggattttgatgacaggattcctgacgactttgtaaggcagtcaccaaaatatcattattatgaggctcaatcaccatcacatatggataatttagtctggcttccacctggtgctgtaattcagcaaaatgcaggtttccctggtgatttgagcaagcacaataaatttttggatgggaacagtggatgtgatcactgtggttcactattccacaagggtcagggttcggtgactgatcctatctatatgaatcctcgttggactcggccagtccaacaacattttgaccaaccaagcatgattaatgattatcccggtcaccatgctaattcttgtccagattactgccgccctggtgagcattatgcgggaggtcaagatgttagattggaaaatggtgtttatgttaaagagcaaaatggtggtcatactcccatgctttataatgagtcacgtcctcacgatagagtctggtatgcgcataccaaccaaagtcatcagcggtatgaggatccaaggctgcattatcctactaatgatagagtgatcgagccatacattgtcgatgctagctctgtaaattccgcatttgcaccaaacaaagtatatgaaatgcattcagcatctcttggtcattctagttctagccatgaaagtcctcactattttcatggtagcagtgagctcataaatgacgcatatcacaaccaacaagttggaggcagtgggtcatatgtgcagccagcagggtctgaagaatcccctggtcagcattacaaccacttttcggcctatggtgcagattccttttatcaaatgcaacaaaatttgccacccattcaatctttgaggaggagagcgaacagtcctgttcacactgcctcaccatatgattccccacacctgccaataccaaatgggagcattaacatgaattctgttagaaatacaggtgatgcgagtcccaggatagcaggtcttattggatatgatcgaatgccaaacccatttactccgcccaatggcagcatactatatagagttggtgggcatgatgttcctgcagctatggagaacactagtgcttttggtcctaggtctaatccaactgctgctcagtatgttcagccttttattgctcctgaatcaatccagcatcaacctggagttcccttgagggaggtttatcctgaaagagcataccctgaacccatgccgtcatcatatgctgatggcaaagtagctgtttctgcattgcccctcaccgaccaattattcaggttggatataaacacaatgaagaaacttgaaggacaagatgatgggaactctactcgaaatgtgaatgaaacaactcttttgcatgctgtggatgaaccaagtaccttaccccaccatgttggatctgtacatgaagtcgatcctaagcaggagaagctaaccgaaaaagaaagcaggcaaaagcaacatgaagctggggctacagcactgcaggaatgtgaggatatttcagaggatatgttgaatttccttcctgaattaattgcctctgttaaaaaggtaacactggaagatgctgctgagacacaaatagcccaatcagatgctaatgctgctgtttcacctgttcctgatgatgacgataatggaaagaagctggatgaggcaacagctggtaatacaaatgcaaatcaggaccttgatttgcaaggaagccttgatcggcagaagagtttcaagattgagtctacaactgctgaagctgaagctttgtcgaaaggactacagactataaaaaatgatgatttagaggaaattagagagctgggttcaggtacttatggggcggtctatcatggtaaatggaggggatgcgatgttgctattaaaagaataaaagcaagttgctttgctggaagaccatctgaaagagagcgtttgatcacggatttctggaaagaagctctgatcctaagctcacttcatcatccaaatgtggttgcattttatggtgtagttcgtgatggtccagatggaagcttagcaactgttactgagtttatggttaatgggtctctcaaacagttcctgaggaaaaaagacaggacaatagatcgccggaagagagtaatattagccatggatgctgcatttggcatggaatatttgcacgggaagaatatagtccattttgacctgaagtgtgagaatctactggtgaacatgagggatccacagcgaccaatctgcaagatcggtgatctcgggctatcaaaggttaaacagcatactttggtatctggtggtgttagaggaaccttaccgtggatggcaccagagcttctgagtgggaaaaacaatatggtgtcagagaagattgacgtctattcgtttggaattgtcatgtgggagctgcttactggggaagagccatactctgatatgcgtgctgctgaaattattggggccattgtaaacgattccttacgccctcaaatcccttcatggtgtgatcctgagtggaagggattgatggaaagctgttggtccagtgatccagcggagagaccgtccttcactgatatatctcaaaggttgaggaaaatggccgctgcaatgaatgtgaagtga
